United States Patent 9,309,511 (FUNCTIONAL ASSAY FOR IDENTIFICATION OF LOSS-OF-FUNCTION MUTATIONS IN GENES) - sequence listing, part 2

SEQ ID NO: 31 - DNA, 122917 bp, Homo sapiens
ggccgtgcgagaggccgagcttgctgcattgcagccgccgcggcgccgctcggctcttcactcccaacaatggcggctccgagcccgagcggcggcggcggctccgggggcggcagcggcagcggcacccccggccccgtagggtccccggcgccaggccacccggccgtcagcagcatgcagggtaaggaacgcggccgcgccgagatcccagccccctagcgcggcaacccgcgtcgtcgcggcctgccccagcggacgcccccggacccggctgaggaagccacggcagccgccggcttctccctctctccctccccggcttcccgccccgctcccggccgcctccggcccggcttggatccgggctccggcccgcataggccccggccgcggcctctgcctgcgcttggcccctgggccctaccgggctctcagcaggcccgcagggcccacctggtccgggaccgcccccgcggccgtccccatcgcccccgccgcttacctggcgcccgcccggcccccgtttccgggaacgcgccggctcggggctgcggcggagcgggaggggcgtcgggcctgccccctggtccctgacgccgctcaggtaggcggcgaagacagcggccccggccggcgcccctcggccccgccgccgcagtgggccccgctcagggccatcttggctgtcgccgggcacagctggagccggaccaccgagctgacctcgggctacgggggcctcttggaacctgcgttttcaaacttttgcagggtttctgtgcgctggaagggatgggggtggggggcgggttgcccaggcctgtgccacctgtaaggtaggtaggctgcattggcctgggagaggcattttgttccaggccagggatttctgtgttagcattgcgtgcaggaagaaaaaaaaaaaaaaaaaaaaagaagacttaatttggtttaaatggagagatacaggaaatagacaggggtcaaagtgatactgtagtgtctggacatttgaggcagctctgctaattaatgactttccccactgggaatgcttattagctgtgtatggcttttgacagggggtgttgtgaaaataccaggccaggcccgagcctgttagggaccatttccttaaatttactggggaattttgagtagtaatgctatttttaaaacagggaatctcagaactctcttgacaactttagcaaactgcttgtgttgaattattaacagaataagggttggggtacccttggtagtcagtgtgaccatggttactttttgattccattcctcttaaagggcttctagcatttagttaggttcaacagacatttattgaatagttcatgtttatagagcatgccataattcagaaagaagagacaggattttatttatctttacatccctgtcaccctccccatgaaataattttaatatacataaaaaccagtgatagatatatagacaggatgatgtcagagcttagaggacactttctgtgcaggccctcagataattcattcaaattgaattagttattggatgcccactgtgttgcacagcacattatactgatgaagtataagattgacttcctgactgtacagctttacaatttaggtggtggtggttggggcgaaatgaaatggcaaaatgacaatttaggattgtatttcttgttccagatgggtgacttacaaagcttataaaaacaaggtgatttgtttgtttgttttattggtggggaggctgacagtttgaaatagctggatacagtgtgtttttttggttcaaaaaatatttattgagcatctgcataaaacgctcatgctgagtttatagagaattgaacatctctaactgtcctcatggaggttatccccctgtgaagatgggggagggaaggctatttagctaaacatgaaaaattactagttggaaaagtaataaaggtaacaagctgggttttgtgatagaagataatagagggcagtccgcttgataagatggtcagagaaggcttgtctggaaagctaaccctcttttacctgaagacggttctaggcagaggaactgtgtgtatgaaggttccaaagcagggaagagcttggagtgttctaggaactcctaaggcagtggttaggactttttctgatgctgtccgttctcctcagcccttgtatgttgatacccagttaactaaactttctaataagcagaacccattttagaaggaaaaaggacctaagacctctctatgaattattgccgaattttcttttttatcaatattgtgtctagtcttgattgattcaggaatgtgttatatcttgttcttgaaacttttttcattagtcagaatgaagtgcttgatattctcaggatgttgtctagaacagtctgttataaagcttgaacttaagcagcaatttaggatccttctttttggtttgttttgttctgtatcttaattgtgaggcccttgaagaggaaatcttataagaacccaaaaagaaagattcccatccaattgtatgggagtcacacctcccatactgtacttcatctgccaagggtcttcttttgctttagatcagacttcacagagtgggccttagaagatgtttgatgtacttccattccttctcccccaatctaattatacttgccactcaaaaaacttcctttctgggagttgttaatgaccatgctctctgaaacagcaggattcagttgtggaacataaggaatgtttcatgcagtagacattggacatcctcttatgtggtaagcactgtggtgggcactggataaccttgaatactttttcatggcttcatgtttatggcccaagagtggtccaggctggccaatattgctttcttaatatactgcttaagaaccagagctctggagttctgggtttgaatctcttggccaggattcagatatgcgttttgtgaccaggggcaatgaacttggcctttcgaagcctcagtttctcacttggaaagtgggaataacgcttacctccccggtggctttgagaatgcatgtaagcctgggacctgacatgtagtaaggatgcaatacacattagccatcattgttagtagcgacaatattgttatggtctcattaatggtcccttttactattggtaaatgagtccctaacctctcattatttaccacacaatttctttagttcatattactaggtcccactgttctctctaacctgttgatttccccacttttcattattgagcagtcctttcagagtatcctagatgagattttattctacttcaaactccggatctgtttttttctggatctgaggactctcaaatgaattacaatgtgaacgatatgaaacagaagtctagctatcaatttgctctactcatttttttcataggggatgggtagatggttggaatgggatttatagtgaatttgattataagagtaatcaacagacgtagctttggttgcatgtttatgctaacagttatggcttctaatctggccatttttgccactgtccctcagataatagggaatagctgctaattttgttattactcaaaagatttgagtgtcttcactcattctgactcatttttttttcatgttcattcacaaacacacccaacctttatacgttgagtagttcttaggctttggttctttgatgactaaagctaacaaaatgtagatctgtttgccaagttaggtaagtggttttatgaaagtatatttggcattaggatgagtttgcatttgagagaggaaacaatactcaaattaactactctgagaaatgtttttattcttaatgtttcatcaataatttgttaatgtagatagatttaataggaaaatttcttgcatattagggcctcattctgtggaaaagtattattctttagtccaagaaattttagccaacctaaagtacggaattgacttgtagcattcaagaaccttcctagccatggctagggctttcccttgtggcaaatctaaagcctcgtgactttagctgggttagtgtgaatcctgtaaagagaagatcccgttataccaggtaattaatcttagatatgtatagcaaatagtactagatagtatggttggcatgttagagaatagcatattctgattaatagagcttgccagttgagaattcaacagcttctataatgaaattgcataggcaggatgattccttttccagtagtagctgtagcagctagcgttcccatagcatgtagtaatgtttaagaaacaaaaggatgttgaagtgtaaagagcactggacttagactcagaaaaccatggttaaggtaactgctctgctgtttacaaacactgagattttagggaaattccctaacttttctcaactctctgttcagaaatttctcatctgttaaaatagggataatgcctaacctgtagggccattgtaagaatcacattcttaatgcatgtgaaagtgctttgaaaattatagaatatctataagtatatacagattgttattagacatgattatttgcctgctgtagctactaatcacttaaaatgtaatagatttcaaagatcgcttagctgagaaatgtcagttttcaatagatgttttcttaaaatggttagaatagaatctataattgattcagaaaaacattgagccatttgtaaaatacttgttacaagaaatagttagaaagtatatgttgtaggtgcctctgattctcttaaagttctgatttacagaaaactttgtgaccagtcgagtccttagctatttacccttagctgagcatttttatgtatcagtttaagtagaaagatgatagcttgattctgctttagaaaacacgcccagtactttaaaatgtaatgaagtatatctgttaagaaaaagtcaagagatttaaaatcaatgtagttatttctcccaaaaatatttgaatataaaatgtatatgaaatgtcctgcttttgattttgtttatctgtttttactaattagtctggttttcgagaaccatgggagacctttatcttaattttaaagaactgatttgtgcagacagtgaagagtttcaaaccccagaactgcttgcccttcccagtgtgttgcataacatttcttttactgtttaacataacctcatacaagttcacctcagcaaattagtcccccctcaaagctcagactgcatttcttcttatgttcccttaaaaattagagcaaccctagtattaaagtaaaaaagtggaaaaacatctcacctcacttttagaatacatattttctcacattttcctttaaaataccttactagcctgaatgtgtgctgaaacttgtttaagatgggatattagttaaccctgtattttgagtcgttttcttttttcgtaaatttttcttctttcactaatttgagaagctggattgatgtgagcccatagagtttccttatttttaggggtctggatatcataatcctaactccattctacataatcgaggtcagtctcctttgtagtctctaggaagtgcagatggctccaatgatacaacctgagaaactttaattgaggcttaaaaaagaaagggaaagtaacagttaacaacttttttcactgttcctacctaatttgatgctcacaaccaccctttaaaggtaagtggacatagtccccttcatagatgagggggtagacgtttatttgttccggaagaggtaggttttaaccacctgggtgactggtagcctttgctcctcttactactctactgcatggttctctgagcctctttaagtcatttcggccattcaggtctgaaggaagcatctttgccagaagtgatgcagattcaggaatggaggagagagattattttaggtttcagtcagggggcggaagctccaagcaaccagccaccttttgagatgattttggagccttggtgctccaagaatggtgcacttcatgttacaatgttctaaacttgctggagggtttacagtggcattttgaatctggagacatttcgattgggaatctccaagtaagtagaagactttaattagaggaaaccattgcagatttgaaaggtaatagaatccttttaacactatatataaaaggaactcatttgtcataaaatttaacaaatgttgtcgttctggctaaatttgtaatctgggcaaattactatttttgctagtggatgtgggttagcttctagctgtttcctcccaactctagaaaatcttcaggtgtctcttcatgctcggtaaggttgggagtttaatgtgtacttaaattaatagaaagtattcaagtcgtaagactggccttgcttgtagctacacagtgaaagggagatgattagccagtagtttacacaactcaaggtgggccttttgaatgaagaaaacaattacattgtatgcagcttggttctttaagaacaacacattattctccaccacggagaaagaggattaaaatggacatcacagcagctttttcgagctatattgtatttcattttacccaaaattgctcaaacattgaaaaacgaggaatcaagaaaagtgttgccagacatatatatctgaacatacacacacacacacagacaccaaattgttcaaacatttaaaaaaagaggaatcaagcaaagtgttaccagacatatatatctgagatatatatatgtcagatgtatatatatctgacatgcctatgtctatttattgcctggctttgctgaagaaatcagtgacattaaggagctcccctgatgattttggcagtttccctgggatctggttatgtgcctgtcatggggaagcatccatctttttggggttgttagagtcctcaggataccaggctgtgcctaggaagggttgtggcagaggtgtagagggtggggtgtggatctccagggctgtttggagtccttcccttttaattctctcaaggtgactgtgaatgaaaggagaaagactggttttgtgtaggttaagctggtctggtgagcaccagaaagatagggaaggtgccataatcgttgctcccatgagggagagaacaggaataatagtgcctgtgataataataacctgctttagtccaggcttttggttggacattttagatatattttcccatttaatcatcacaaagctcttttgggtattattttatttttcacaaatgaggaaattgaggctcatagaagttagatacttgcccgaaggaacataattgtaagttactgtctcagtgtactgtgcttcattaaacaggcttgagaaggtaatgtggcatttaattttgtggccaaagaataaataaggtggtcattgcccaaagagagaaaaagagctggcattatgaggacacttgaatttaaaaagtgtggaagggatttgatgagtattttatcaactcctgactggtggatgattctaacaacctggaattgctaacttagggtggctcccttttgatagtttcagaaagttgacataaggaaatctgaaagaaataaaccatcaggaaataaatcttggggaacttgctctgagtacaatgaaaatacaaatttagggtaggtttagataacgccttacatgttagagccataatgatatactatgggtagctgtggtttaaggcacatgccagaattttgaagttggaagtttgaaggtgtcagacaaatagacccttcatgcttgtgacagaggaaagactttgtagcacggtcttatgggcatgacccagtaaggcagctctgattttctttacattagtgtgggttcatattgtagttcataatgcactttcagcagtgcaaaaatccagaatgtccagggaatcagaagcaactactgaggagataggaaaccacttatgtccggccccacaccctctctgatttatattatcaacctagaggaatgggaatggagataactacaaaacctcataatggccattacacaagcaaaattagatttaggcacactgttttcaaacccttaagataatattctttatttaaaaatgacaaaactaggactcaagtgaaatgacttcagtttcacagttggaactagaactctggtctcctaacacacttcattttgttttttactttatcgaacaccatttgctttttgtttttataaacacttacacatcctaaacagccgcttacctcactgtatttggtaagaacagtaaattgtaggtttcaagttatggccacataaaagatcttaaaattgaggtaagagggtgagaatgaggggcaaatgtgggaacgagggtaggagatacgtagagagaaaaaggaggaggaaaaaccctcatgtagctttatttcttttataggcttactagcattctgtcctatgcattttgatattgattcatcagtgtcaagaattaagaatttaaattcttaaataaatattattcttgatatttattctaagatttaattaaacttgcctggggccaggaaaaatgaaaaagactcaaatttacccctacttgtaatggggaaaatataaatggaggatcatgtcaaattaagccccagggtacagatagttcacccagatataaaaaagtgaggcacacacgacttaaaatgtaaccagttaactatcaacaggttcaacggattatctagtacctccagagataggacttaaagtaagtgaataggaagtcagaatttcggagacaagggagacttcaaaaattgaacatattggccaggtgagatggctcatgcctataatcccataactttgggaggctgaggcaggaggattgtttgagactagcctgggcaacatgttgggactccatctctacaaaaacaaaaaacaaaaaactccaaaagttagccagacatagtggcttgcacctgctgagatgagaggattgcttgagcccaggagtttgaggctgcagtgagctatgatcatgccactgcactccagcatgagcgacagcaagaccctgtctctaaaaaaaaaaaagaaaaaaagaaaaattgaacatatgtgagtgaatactagtgaatattatatcataactaagaacttgcattttgtaaagttgaggatattggaagttttcctcatttttccttcccaccatctttctcttgtgcaagactgttgcttgtcccctttgcccatccttaccctttgagtatgagctagtggagctatttggtactttcccaaatctgcactataagcactaactttctgacttttgcaggtcttaaagatttagacagactaactaaaaacgcttcttccctaatttaataatgttaagaaagttacagaattgctaaagaaaaggtgagccagtgtgttccagttaatttagaccttgcttgtcagtggactctgggcgagttaccaagtattttcttagtgagaaataatgtggagagatggatgtttggatgagaccccagaattcgttcacctggtcacttcataattagatacaaagaacaagtctatacttatgctttgaacattttaatccccttcccacctcctttgtagctacttatatagattctgtactggtgacagaatttcaggttttgagaattttttaacacttaaactggcgcttagcttttaatgtgttagagcaatcattggcgacattctgtcattctcagtcacatataccttaaaatttttaatatattatacacttattaagcaatgtaactttttttaacacaaccttacatatagatccaactgatttctttttcatataccttacaaatttgttttcttgctcctttcgccatccatattactattttgttcacctcttctctctccttttcacctctttctttttgctacctagtaacagtcaatcagggtattttgctttaaagttgtttgtttcccagcctcctctccagttgtagtagaaggtgagttttaccttcccttttccagtgggatgcggggaagacttgcctgctacttccagagaacccttttcttcctgaatgtagtcagctcattttgcgtggtaggaggccagtggcttttagttgcttaggcttgtaagacccatacatctctgtttttctttctgaattctgttcccactgcacatttggtggggtagcatattgaccttcagtggtagagagaccagggtcagaccttctaggtttgccctagtacttctttcccatgaagtctccattctcacttcttcctgcattgtcatttctatgataaggtagtcagcagtggattacttcggtggtgcaccaaagacacttttcatgtcaaagtagctacattagcatttttcagtttttgtactttatagatggcatcttcttagaatcctaagaattttgataactggataggaaagactacttaactatcctttcttcagtcctggctcttttttctgcgtgttttgattgaatttgtttaaacacaaagttattgtaagcttacttccttcattttgttccccaaaacacaagcgtagatagaccactaacaaaaccagatatccatccactcactaaactaggggtgaaagaatattttgtgaaggcttttgttttaattggcttactttactggatgcatcttatcaaaaattatatctgtatacagtgtatacataaggtgtaaccagatccaactggatttgaaaatgtgtttaggtttctaaggggaattcacaggttttcttcttgtaacttctaaagtactcagctttctcattcctagggacactatcttattttttcaggcctattttagaagaatttcagcccctcttcagcagttcattgtcttattgtttgaagttagctaatttactaggaaatgttttatgtgtgtgtaagtttcacaatttatgaactgctaaaacttttgcatcatagatggtaattaatcatgggtaactctaaatcagtaatttaagttagttaagtaactcattctgtatttgtaggttgaaaacattgaaaaaatggacagaactatcttaaaggttactgttaacttctaagggcttgtagttctttttattaaatatatatgaaaaataaagattaagactgcaacacaatttaaacttgatttcagtttcatgtaatgtattacatctacatctgacagagctaagttttttaagaaagctcatgtgttattgtctctggtgggggtaatgtgatttgacctgttcttgaattagttttattcaaaatttaatataaaaatgcaatgtcatgttccaattttggtttgtttgatttacagtaaatgaactggaacttatcttttttactttaggctttcagataaacttctgtgaaaaggcacaaagtaagctacaaattttatgatattatgctatttatttttttcatatccatcttggtattgggaatgtgtccactattgtttcagctaaccagccatggcaattttacattcaaagagctaccatttttcattcttcttccaaatattaaaaaaattatattcttgattgtaaattgtacttttttcacttgaaattgaaatagcaaaatatgtataggtatttagatgtatataatatggaaatacgtatttaggtatagaaaagtatatataggtattcagacttaaccctaatttaaattacaagtagaagagaattcacttttaagatcgtggtgcagaaagtatagagttatattcagacatcttatgctttaagattgaattattataaaccatacattgaatatatttttaatttttttctttaaaacaaaacagtgtttttcttctgcctccctcaccatccttattctgtattaggacactagtcttcatataatacaaaacagactttctatatcaaaaaaaaagttataaaccttgtattttatttattgagacagggtcccactctgttgtccaggctggagtgcagtggtgcaatcatagttcactgcagccttgacctccctcaagcgatcctcctgtctcagcctcctgagtaactgggactgcaggtgcatgccaccatgcctgactgactttaaacttttttgtagagacagggtctcactttgttgcctaggctagtctcaaactcctgggctcaagagatcctcctttcttggcctcccaaaatgccaagattacaggtgtgagcgactgtacccggccaaaaaaaaaatgcatttaagcttaaatgtcatctgtatcaagtacagttaaaaaaatctcatctcaaggagactactctccagttaacataaaaatataccaaaatatgatataagtcgttttgtcttctgctttttattcatgaactggagaagaatgatgctttgatatgtgtcattcttaagtacattgattcaaaggcaaaaaaaattaacctggaaaaaacatttctgctatgtttaaatttttttttggaatgagaatgcatagtttccactgattgattgttatgactactttgaaatgtagttagcaaaaatttatttcttgaatggttcacccacaatgtaactgtatataaataatagagatcaagcagttagaccctaggataaaagtttttttaattggttcattactgttatgtctcccttgccttaaataactgactaaaagtaatatatgatttcctgctcatagtgaacctttatatatgatatatatctatatgaaatgaagttacaacttctgttttatgcttttaattttgacacattcactgtgataatttttagctttgacttttcaaaatgtctgcttaatatttagcatgacaacgtttagcttttatttgtattttgacctaaaatctaattaatgaaaaaaaaaggctgtcttctatttttgttcatttcggagacagagtctcactgtgtttcccaagttggagcccagcctccaattcctgggttcaagtgatcttcccacctcagcctcccaagcagctgggactacaggtatatgccaccacacccagctcattttaaaatttttttgtagaaatggaatcttgctatgttgcccaggctggtctcgaactcctggctttaagcagtcccacttcagcctcccagagtgctgagattacaggcatgagctaccacacctggcctgactttttaaaaattttaagttgtactcacattattgttcttttatttaacctagttctattgtagatataaaacaagagaaacattgattatagtaaaattgtatatacagtgtctataagtagctttgtatgtggattaaaaatgcttttgaatcttctaaatggctctgtttttgtcattatagaaatgataggtttgcagtgcggcctgctttgatacatatggaagaatttaacaatggaggctgggacagcggaacctgttagaacttaattatgtggtggaggggcatatgtattcccactttgattattcaccttgattgccctcactgtctctttacactgtggctactttctgctggcttttcacatctctctttttatttctgcctcttcccattggaaggctcctctttattttccagttttgggattcaacacagttatttatatacattcacgaaatcacatattggacacctagaaaccatacagtaagcgagattcttggtacagaaatgaatggaataggcccctgccgttagcaagctcatagtttagtggactagagttgatcctacattgattacataagtgttcaaccaccgatgttacatactaattgatttttaactggaaccagggtgaggatggtgcaggagtggatctgtcctggtcacctttgctcctgctgttctctcatgagagagaatgagcataaagggtgctgagagtctcatgataactgctttcttgattggacactgtgtcttagggatccaacaatgggcctaccctgctttggagttaagcagatgtgtctgtgctggctcagacctcagtgaaagactcagggaatgggagtgcacacatcagggaggggagctggagacttggtagagatggctagccctaaattgacagtatttatttttgtactatcagtacctatattttagtataagttctcagttgcttacatatattagcacttcttctaaatctggtcctgtgatttgcatgacttaaaaaattagaagtgcaaatctgtaatgtttgcagacaatctgctggtttgctctggaatatagacattaactttatggtaaaagtggtcacacttttctttaaaattgggcttgggctgggcacggtggctcatgcctgtaatcccagcacttcgggaggccacggcgggcagatcacctgaggttgggagttcaagaccagccagaccaacatggagaaaccccgcctctactaaaaatacaaaattagctgggcgtggtggcacacgcctgtaatcctagctatttgggaggctgaggcaggagaatcgctgaacctgggaggcagaggttgcagtgagccgagattgtgccatggcactccagcctggtcaacaagaacaaaactccgtctcaaaataaataaataaataactccatatcaaaataaataaaataaaaataaaggcttgaaatcatcaaaggactgatttctccactgttggggcacacttatttctagaatctccacttttattctaaggatatttcagaattatcagataaacttatgtttaatttattaaaaagaattatgtatcatacagtagttgtaggagggtatggggcaaagagcatgaaattagatatcattcaagtctgataagtctgagtactggctgcttcaaatgctcaaatctatcacaaataaaaaagatttattgtaagatgattctgatgactaatggaagctctgaaggattaatttttttcattgactttcacatagtttttgctctttatattgctatgtcactctcttttaatcactttattacagttgcctgttacaagtcagtggagttttattggagatgtgtgtgtgtgtgtttacatgcacaaatagcgattacatatttaatttgggaaacatctctgtagaaattcaataaaaattcactctgctcctcacagtcttccttttatagattatagttcatgcatttatctattcttcagtttattttctaaatataagtttattttagataaaataaacttcaagttacatttatttaagaccatagtgtcatgtttcctttaatactgttggatcattgaatttttctgaagtctgaatgtaagaacactttagggaaaaaatatttttccatttgtaaatgtagagttataagtgtagaggtcctgccttagaaggttgattaatttatctgttatttgaagataatgtttttgtacatgtaaaggtatttatataatttatgaccgtatctcactgactttaatgagctaacctgtgaacatagttgtttagaatatgacttacttgctttataaaaccattttttcattttttatttttcgaggagggatgaggatttgcctgaaaacatttttttctcacaagctgcccaactaccaaaaaaatcattcttccaaaacctcctgatgttgattcctcatgaagagcagttgagttgcccaatgtgtgccactcatgacagaagcccccttttttagaaacacagtttttaagaaatgcttttatgaagttgaatttaccttagtgttgtcagcattctaatttttttttttttcagatgagaatcgtgactcatttaaagatctttgggcataggaattttcctcagaaaatgcctaaccgaattgtgtgctaatcagagtgatagtagctaggcgtttggcaaatactcttctgataatttatttttcacacaaaggtgcttttagctctttatcactatcctcccccccgccaccttttttttgtagctgtagtatattatcagttcatggccgaagagttctggagctctaaatattttgggtagtgttaagtttctgtagctttgtcttttacgtttttggtggcgttaaaaactttgtgcttttaaaaaatgatttaacttggaagtgtttacatagcaacaggatatttatttagaagattagatgctccagagctattattctggatgctacgaattgaaattagagtacaggtggcggtggtttttggtggcactgcacatcagtatatttggaggaaaaaaaggaggcatcctggagactgattttataagtatccctaattgttttttaaattggtaataataaaaaggaaaccataaagaggaagaaggatgttttgtgaatcttccaagaaatttgggaaagatactaagtttactgacctgctaagaagtgtctgtaaatgatgatgttttgactttattggagtggactataggaaaacaggaaaagcaaggagcaaagggaaggttaagttgttctgcatttaaaactaagaacttagaaaattcagctggttaaatttctgattcctcgttttatgtagcaaaagtctgcagccagtgacaaaaattatataatttggaaattattaaattcaactgagtttgtcagcaatcctaagaaacaaaatgtcatttactgctcttggaggtttatacagtttatataagtttatatatatagttaatgaagttagttgaaaaatgagacttgtaggattagccgtaagccagactaacatctaatatttattaccatttgtggggaccatgataaattgtcaatgggaagtccatctgcttggaaaaaagtttttatattagttaaagcccaggaattgtagaagtagaagtggtatattccagagtcaggattcacctattcctctcatactttatgcttataccttataccattacaaagggaatgttgcttagttgtctttgaccttggaaatggtgggaacatgaatttgtcctgaaaatgctttttgttgctaggagaaggaaggtttctaacagctattgcaccttaaaataatttggggatgcttaatgtgtgacatttttgataagaaaataattagtgactttcccacattgcagaaagttttcatttatatgccacttgaactttactactagcaacaaagggatgttgacagaactttcagagttgaacagatacagagtagaaatgatatggaacgtttccagagagtattcccaactgaatccagttaaagtggttttcaatttagctcatacatttagggtgatggttttcagataaggtgtagtaaatatttggattgtcactacatggttttatgagatccgaatctaggcaaaaatgtacagttaataagatgcactaagaaaaagttgtgacttccatcttggtgttcattttccctgggtagaaatgccaaatgaacgttaatcagaaaggaaaatcaagtgcgtacgaacatattcactcccctttagagaagctcttacaaggataaggaaagagaggtacaaatgttaacagttaacaaatgtgtatctatatataccttcgacagataaagatattaccaatgataagaagcactgggatccttaaagatgaattaaatctagagcctactctgaagaagtgtatgttctttgagagattgagcatatataggagctatgtggtagaaataataactcttaatgtgtgtcaaatcctgctctaagcactttatattaactcctttaattctcacagcagccttatgaagtaggtataatagttaatatagatgaggaaactgaagcacagagaggttaaataaaatttccaaagtcatatagctaataaggggcagaactgtgtgaccttggtctggtcacagtttacacgttgtaaaccttagtgttttactaattcttgaaagcagttggcgcttataggaatgattttctaaatcaaatggcttttgaggagtcctcatttgcactaggttatgagatctggacctaccatttgtatcttggtaagccatttgtaaggcttatcaaggttatccagtaagccttactgaacattaaagtagaaagattcgtgttgctatgaagttaggaacacaggggatctaccactagggaaaacgatgtttagtgaaaacctaaaactctcctggcctagacagatacaaggaataaattgctccaggattctgaaatgacttatatgcctgggtacagctggagaagattagtaggtcaggagacctgtgaagtcagtggacaaggtggcacagccatgaactttgtgaggacagactgtgtacagactgtcataagaacaaactgatgcttttagcaaaatttttatgcatccccaccccactttctttttggcagggttagaagaaagatttaatttttgaaaacttttaatagtagaaaatttcaaacatacacaaaaatagagtagtgtaatgaacccccatgtacccattatatagcatcagcaattaccaacatatagccaatcttattcttcttccctccagctatctctgctgaaatactttaaagcaaattctgatgatcattattttatccacataaatgtgttacatgtcttctaagtgataaggactcttaagtacataaccttgatacaattatcttaccattaaatgaacaaaacaatattactagatagctactcaatgttcacatttccccaaaagccttgtaaatgctttatttacagttaatttgttcaagttgagacctcagcaaggtatgtgcacacattgtgtttggttgatatgtctcttaagtttctttaagtctgtggtaattccctcttctctcttttccttaccattttttttgtttaaaaaattggttaatttattttgtagcattttgtatattttgaatttagctgattgcatccttttagtgtttaacatgttccttcatgccctgttatttacctttaactggtagttacagaaacttgatcagacttttggcaagaacacttacttcatagacggtgttgtgtgcttcacatcacatccaggtgtgttgttgtatcacatcaggaggcatatgatttcttgctggagctcttgttaagataaaccaatgggcttaggtgctgccagtgtgatccatatagtgtaaagttctccgtcagcctttcatctggtagttctggcccattaactttgcctacattaattattttcttaggaagaggttgactctcattttcagacatatgtgggctttgcagatagtagttgtatccagccaaaaaaagacaaaatttgtgtttggggcatacgactgaaagcaaattatagttaagccttggtcatctctgacttaactatgccagtactgaaggatatgaaagtgtatttatatgcacacatatgatatacaaacatttattgggatgctctgtattttgatagaataaaaactggatacttgtcctttctaccctggaacatgagttgacccgttcattagggctcattaatctttgcagataatcaaaagccacgtcaagtaataagacgttctctggtgaagttgaggagccaatggttagacaagactagtcctgccaaattaagatcaatcccacatcagagcccagcttttaaaatttgtgttcagtgcttagaatgctcagatccttcagggcattgccttcccaatacttgggaatcagattgagtcatcaaaagtcagtttggtgaggattagaagtgagtaagagttctcatccaagatttaataataaaaatctgatgacctacttgtgttttaattagtaatgaccttttaatgaccagtgtattgttgtccagttggtgtcatttaccctttagcagtaataatttcttaaccagctttccttttttcctattcctgttccatcatctaactttaactaaattattaaagtctctctctcataatgttctacaactaatttgctcttttgattttctttttgggtctttgtaagtaacaaattagaaacatttcagtcgagattctctcatgtactgtatacacatgaagtagatagaatgcagcatatcttctttgagtgccattcacgctcttgattattcttaatttagtccaaccttttaaaactttcaatttgtagaatacatttatgggcagcaaatagttttttattgtgtccactaggaaataaaagtgtcattcacgtgttaatatttttgaaattgggagttatttaatgagggtcaaaagaagccatttggatgggaagaggagtataatattgctaattattacagtattacctttgtgtggaagatgcctgctcattttctacctttgttatttgcttttgtagtgacatagttggattttaatttaaatttgactgtgaattgttacctaacatttcttaaaaatgattatatagtgaaatgcagtgctgaaatggaaagttggtggagtatacaaaagatcgccacgtcttatgactcatggcagttaaaaatgccacatatcgttttcaaagccagaagatgtctgactaatttttgtgtcatgaaattctattgttagcatttttctactaaaagcttctggtaactttttcagagaacctgcataacatccagttatacatattttgattaatgaggaaaaaaaagaaacaacaaattggacccatcaggaaatacagataaaacaccctattgtgtctcttagtgaaactgtttgtcctaaagatgttaaatcaaacatttgagcttcgattccttatttattgaagaaatatttgagttcctattaaatgacaggtgctgttacgaaaagaactgagttgtcggactcattagaatgttctgtctgatttccaatggtcagaagtcatgccgatggaggctgggcgtggtggctcatgcctgtaatctcagcgctttgggaggctgaggcagatggctcacctgaggtcaggagtttgagaccagcctggccaacatggcgaaaccccgtctctattaaaaatacaaaaattagccgggtgtggtggcaagcacctataatcccagctacttgggaggctgaggcaggggaattgcttgaacccaggaggtggaggttgcagtgaaccgagatcgtgcctgggcaacaagaacgaaactttgtctcaaaaaaaaaaaaaaaaaaaaaaaggtaccatgtagtagtaacaggttatttgaaggctctctaaatggtcttaattaaaatataaacaaaattatgtatatgacttaattattcttttgcctttccggattcttaaggacagatcatggtgaaaaacagttattacaggtaaagtggtgtgaattgtttgctttgagggtaaagtaattggtcagttggacaaggtagtcaggtgtgccctggagggtggagagaagtcagcttggaataaaaaattaactgaacctgggcaacatggtgaaaccccttctctacaaaaaaatacaaaaattagctaggcgtggtggcctgtaatcccagctacccaggaggctgaggtgggagtatcgcctaagctcgggaggtgaaagccgcagtgagatgtgatcatgccactgcactccagcctgggcagcagagtgagaccttctgtcagaaaacaaacaaacaaaaaactgtgattcactatggagtcgaaaagaaggaaggtagactctctgactttcctgagttaggatgatgtggacgtacacactctttgctttaagaagatgttcttggccaggcgcagtggctcacgcctgtaatcccagcactttgggaggccgaggtgggcggatcatgaggtcaggagatcgagaccatcctggctaacacagtgaaaccccgcctctactaaaaatacaaaaaattagccgggcgtagtggcgggggcctgtagtcccagctactcgggaggctgaggcaggagaatggcgtgaacccaggaagtggagcttgcagtgagccgagattgtgccactgcaccccagcctgggcgacagagtgagactccgtctcaaaaaaaaaaaaagatgttcttgaagtcaggagtctgctaggtatttgaaggacatctggcttgataatccttgataatattttcatacctgtttgtaaatcaactattgatatatgatggagaaaaatatattcataaaccatatcttcctactttatctctaattcacttggaatttgttttacttgtttttaggcttgtttatgtatttggatagttataaaaaccaattacaaatattaatggaaataaggaaatttttatttcatatttccaatattgacaccttgaggtgttttctgacaccaagcaattctctgacagcaaccgtgtatccaacaattgaattcatttctgacactatttacctggagttagcatcagatctcacaagttgaagggctcagtgcttcaagattctcctcacttaggatgctagtcacaaatggggtgtttaggatactcatactcctgcttggatgacttcaaatttgggggttcccattatcaaacttgaccacaacccccatcaagtttgataatttgctagcatgtcttatggaactcaggaaataactttatttactgttattggctttattataaaggttacagctcatgaacagccaaatggaagagataggaccctgtatagggcaaggtattgggagtaaggggacaggggaatagcgcagaggttctgtgacctttccgtgcacactatccttgattcatttaccaatctggaagctccccgaaccctattgttaggggtttttatggaggttttattaggtaggcatgattgattgtatcattggccattggactccgtctctagtccttttcaccttcctggaggtgtgtgtatgggggcgtggcagctgaaagttttaacagtctactcacttggttgtttttttctggtggccagcccctatcctgaagttatataggggccctctgagagttaccagactcttgcacaaagtcaggtatggttgaaagggccacattatcggtaacaaaagacactcctgtcactcaggagattctaagggttttcagagctctgtgccccaaacctgggacaaaggcaaaatacagttatatttttcattgtactacaggtacttctgtagcaaaattaccttgcacacaattggcccacagctttgaatctatctgggaaaaagagtggtaatcccataatgggttgtctactggattggtgatttttctgtcgtgaaaaggatgaacatggtttgtttccttggagcaaatgggtacttaggctaggaagttctctgcatcttatagctttctttattctaatctacttgctaatgaagttcatatagaattgaagtgcagaagagttaattacttatgacttatgaccagtctggctttcttgtatagttaataacattattacttataacattataaacttgccaagaaggagaagtcagatctgattgttttgatgtaaggaaaaactcaaacttttttcctctgctttcacaccatacaacaatcaacatagaagactttgtgaccaaatatgggggatttctccccactagcaaacaaataatcacttctgcagcacataccagctgggtgtcctccagttcaattatcacacagcttacctggagatagtgtcagatcccaccggttgagggctcagtcccacaaggctgcccctgcttcagataccagttgttaagtctgggccttcagaacttctgactgtccggctcccagttgggtttcccacaaccctcctttggggttaattaatttgctggtctttctggtcaccagccctcatcctgaagctaggtgctgccagtcatcagtcaactcattagcatccaaaaaatacatcaccttggaaattccaagaatttaaggagttgtgtgccaggaaatggggacaaaaccaaaaatatatatttctcaataccatatttggtagctcctcaatttgtgtgctgttgtgagtacttacgtgtcagctgaaatatggatccccttagccctgtggcctggggccactcactagagctctgtgtcattgtccttgagtcaagaacagacttatatttctttcattgtgttgtacacattttttttttcatatgcacatataaaaaaggtttggaagcactgattgaaaaaatattgatgttatagttataaaatatggttaatgtttttatttcacttataggtggtgaacagttgttaaaatagggtggtgataggatgtcatggcatttaccaagcaggaaaaataaatgtgatgtaagacctgtgtgcacgtggttccttgctagggttcaagcaagctgttcttcagagagtatctgatatgtgcttctgtctgtacagtgaggtcagactagaagccactccgtgggctctgggatatagatggaaatcagaacaagccttatgacttttcttgacatagctttcataagtttgcatattctattccttattccattagtaagattgctactaaaaaaataagcatcagttatgtggatggttttccagaaatctgagtatcttgttcttgttacattgtgagacagtaacttaaaactttggggtgctcatgaggagcttaattagaatattgagttggattaggaggcagaggttatcaaagtggcctgtgtattgcaaagtaagagaccactgttgactgttgtacatagaaaattttgttggggttgatcaatttgggtttgtgtctcacttgtcttcatgggatttctgttgatatactcacaagttcgaggcttaaaaacacaaatgccctttggatttgccagagatttaggcatcacatggatttaaaaatggtctgagcacctggataaaatgctgagtacctttactgactcttgctatgctgcaaatgtttcctcttcctggctagaactctcagcacatgtatagcaatagtgtttctgtgtgaatggaatcagtgcaggtatgtagcagattaggccgttcttattaaggactgtgaaagatgatggtatgagtgaactctttaaatgagctagggacaaattaaggattcagagaactattaacacattctcttctcccctgaaccaaaggtggagataactggctgcctccttttgggtatccatttggaaccttctcagagtggttgtgtaattgtgaaattccaactcttaggttcccatgaagtctacttgcaaaatcattggaacatggaattggggttcggggggttatttcggataagctttttatattttgttggtgattaaaatgttgttaaatttagcaacattttaaactacagtagggccttctttgattagctggctccctgggtaatttttatggggttggactaatcatgacttggccagagagattttcaatttagcctgtggaattatatatttgcttgttggtagtagacatctggctcagagtctgatagaaagtgttgctgttattggctttaagtgatagctcaaaggtgtggctggctgtggaatcccataatgatggcactgtgcttaattgatgtgaaataactggagatcagagaggggctattataatcaatggcattggtggttagctgaatcagagaatggatgaatcagttatgagtttctgttaataggtttaaaaggaatttagggtgttttgggagctgcattccatgaagcttcataaaccccttattttattataactgaaatgagttaaattttttttttccttgttagatgagcagcttggaagcgagttttgggcttttaagccttccaactctccctgaaggcttttgttaaccaaagaaggactccatacatagtaagaggtagtctacaagtagaatgctgcttttgcctttgtctggtgttctaagaatctgataggagctgttaagccttttgttgtcaaagcagtaccctttcaggaactgatagaggagtgacacaatccttggtattctgggttaaattttttttttctacccaagaaaaggactatgaatcttttgccagaggtcggaaatgctgagggtgaattattttgttttttttttccttgacagtagagcctctgaggcccgatcctgtcagatgaggaaaatgtttaatatttaggaatcatggctgttagtaatctacttttaccctggtttaggacttggccatcataaatgtagacagttatcataattgataataaagctggaatgagtgactatctagctgactctgttatgcatagtaatgcctttactcctcacagtgcccctatggggaaggtaatattaatcccatttggcaggtatggcgctaaggcagagaggtgaagtcatttacccaagagatattatatagctagtaagtagcagagttgagcttcaaaactaggccgattggcactgctagtctatattgatttccctggtttctagtttaatagaattaggaaggatcctggattaggataggaataagatttttatgggaaagtggttttaaacacatttacaaagcaagctgaattctttgttgctaatatattttgttggtttaaacgctatcaaacaaacattttccagttttcttctctagagaatttaatactttctcaattaggttttaatatgtacttataactaatatcatagtagttaccacttttcatgtctactgtttgccactattatagcatatttaagatatattaatccttatcacaacagtactgccaagtagcagactgtttttatcctggtttcacagatgtgtagtgtactagaccacagaaatattcttgtttgtatcttgattagtgttccagtggtatttattagtattttcagtggtgatcatttgacatcttggaaaagaattttctttcctattcctaccctttaacctccttgtactacatttctttttctttttttttgagacaggatctcactatgttgcccaggctgcttttgaactcatgggcgcaaacgatccttttgctttggcctcccaaagtgctgggattacaggcatgagtcaccatgtctggcctcacatttctttttaattttttggcagaatgcccaacgaaacagtctttgtggaggggtcagctaccttatctattgttcatctccactgcctggcatataacttgtttgtaattgtggtatttctgcacttgttgttgtgtaaattattatattgggctttctaaaaatccattttacacacaaaagtgtaaaatgtgctaaaagttgctgttgggatatttacttgatttcttaaactcagaaccatctagtttccaaaatgcttagctgtgtggatgaacaacagtgctttattgatgagagttcaaagttctgagtgagattttatgaactttttagtaattgctcactcttatgtatcaaagattgccagtggggggagataggggcaatataatattagctgatagcagctcacttaatacatggatatatggaatacctgatattgcgagtctaacatctctttttctttatttatttttatttatttatttattttttgagacgcagtttcactcttgtcacccaggctggagtgcaatggcgcgatctctgctcactgaaacctatacctcctgggttcaagcgattccattgcctcagcctcccgagtagctgggattacaggtgtctgccaccacgcccggctaatttttgtatttttagtagagacggggttttaccatgttggcctggctggtcttgaactcctgacctcaggtggtccgtccgcctcagcctcccaaagtgctaggattacaggcatgagccaccgtgcctgacctaacatctctttttcttttgagcttatgaaatattaggtctctcattaccgtagtaatttagggagaaaagagaatgaaagtaagttctttactaccactttatttcctcatttctgaaattgtttgactgtaaagttgcatagttggaattgtgggttactcatttcataaccagtgattgcagataattaaaaaattattccaggtaatctttctgttttgaaaatgaggtagtaacaatgagagccaaggaagaaatgagaatttaaatgacagctcccctctctgcgatgtgatgttctgaatacttgtaagtcaaataccaatattcttgaaggtattctatgaatgacttgtacactgcagttccaggtttctctttattgtgtggtggttctagggaataccctgtggtgtcaatgggtgttccctaaaagggattgattcagattgctttttgattattccttcctggctcctttcgcatgtgagtagttgacttgaaagagcaactgtttaatttttatgattcttttcattagttgggtggtagttctgtctcacctgagcttgcttatatgtatttagtaggtctattaggaagactgggactgctgggccttttgttccatgtggtctttcatcaaggagaatagactgagctgcttcacattcaaactcagggtagctttccaggagggcaaaagtggaagctgcaaggcctcataaagggcttagatttggaagtcatacagtattccttctgctatagtattgtggttaaatcaagccccaaggccagcccagattcaaaaggtagggaaatagacctcacctatttatggaaggagcagcaaggtccctttgcagatgggtatggactcagggagctgtggttccttggtggttatttttgtgacaatctaccaaataacctacagtgaactcagcattatatcaaaaaggttatactctagaggcagctattgtagatccttcagtggtcttcattaccatgaacaatgaagtactttgctgttactacaacagatgttaaacaagggctatcaaatatggtgatatcagtggagttgaagatatgcagattggctaaaatgttgtagagacggtttccattcttacaggctgggtgggaggattctagtgattgtagttctctgattctgaccatacaggtaacagaatcttgctttcctgtgatataatgaaacgaaacaagcccattagatggcggcagggggcagggggcagtgaaatgttgataagaaaaacaatctactaataattctaatttaataaatatttgttgaactgctgttttgtctgaggtactgttataggtgatttgcagagttcaaagataaatcaagatagttaaaaatttaaagcagaaaattgtttacaattttttgatggaaacagacttgaggatgagaggatggtaaggtgagcccagtgtaaagtgtttcttcctgagggacatactgatgtttttggaaactaaataatgctggctcttaatagaggaactgacaccttttgctgttctataaaatgtgaaggagagatgcttttggtaacctagattgcagagattccatagattttgtattgagtagtggactctcaactgcccgtgttgaggtttttggccaagatcgaagcaaactatatgctcagcttagctggttgtggaaagcaatgttaaaaaggtttgtattgcttgagaagttagtggagggagaatattcagggctctttatcatcttgtttttaaagctaaataaacctggaaggtgtcttccctccaacttcaatattctgtgagtcagtgagttgctcacaactagacaaagggtattcctaggcctcagtgaatgtggatacacttgaccaatccctttcttcaggattacagttcttaatattcttgatgattccatgtttgggagtgcttttctcatgagaaatttgaggaagacactgtgtgccgatgctgtgaaaagcttgtttgaaaggtgctggctgttctcttaaggcagagttttgaaaccagaatttcaaggatgattctgacagattgttgccctcagccttggagtggctgagtggggacaggactgctcaatgcctaggccagcctctgggccagctgcaattctaattttcccagcatgttgaacaaatattctcatcttttaaacaagccattgcatgaaaaaagtaggcagtattgctttgaggggtggaacagtgctttggaagtgtgatgaggacaggtactgttcctaagtcagggttcttggttgcaaacaacaaagatttactccagccaataaccatataggcttaagttgtctgaggctgtccatgtcaactttattcccaaatcaataaacatttggaagtgttttctgtatcaggcacagagctaaggttttaggtatacagagaatctctcgcaggaaaccgcttctgtataaatattttaggatgtttgatgcctcgtttctctcctgctatagttaaagggacaatgtttatctgtgttgactggttagaaattgatgatatgacagtcccaccaaaggggttattataatcacaaattcataatgtttttgatcagttattttaaaccctgttgtacaaatatttcaatctttgttagcatctaaaaatcttcacaggtcatttatagtatcacgtccctcctttctccctgtgaaagttgtttcaagtttttgaaaaaaattcatattaatgtcctatttgcttgtaattttttgtcattaaaaatatctgaatacatggtgacagattgcctttcggttttgatttttttgagggacccttgaaaaagaagtaaaggagagaaggacccagccccagtagaggctctagtacttagagaaagtgaatgggagaggagaagatgcctttttttaaaaaaaaaaaagctcatgcctccaggtagccagaaacagcttctcctgagtattgtaaaagctatttttctacttttcttgaatctcaccttcggttgacattttggggccttccttttcctcctcaaaactgcctttcaagttcatcttaaactgatcagcatttgaagagttggggtacacagatgagacccagcaaggtaacttgatcatgtgctaagctcgttggcacttgttttaggctttgagtgatctttgcttggaaaggcttcgaaacctacagaattacttagtgtgttttgttagtaaatgatcagaatataaatttggactttttcaagataattgcagatgtctctgaagtgtagactgtgtttaaatctaatttatgtaacttaaatcacattctcttcatcatggtgtacgtttatgaagttaatggcctttaaagctttcaatttagtttttatttaaatgtgaatgcaatgctgaaaaaaatctctctgtgtattcagtataaatacttatattcaagaaaacagtttaagttttaactgttgtaatatattttattgtttatctggtaaggttagctactattccgtcaaattgggctttctaagaaaggaccaatttttgtttttctttggatagttttcacaatagttctttgttctgtccttgtcttgcattttatcttagtcttatattaatttttcttcacacggaggtaatggatgatgtgccagatggtttcaaacacagactacatgacatatgctcagtttttgatttgaggagtttgtaaagattttcttcaaattgtgatagcaaagttccttaacttaattttttctgtaaacgatttgccatattaaggtaattaataggttcaagttccagagattaggagcttagtatctttggggaccaccattcagcccattacagtctgttttctgggccccaaatattcatatccttcccatgtgcaaaatacatttaccctaccccagcgtctccaaaattttgactcattacagtattaactcaaatgtaaatctcacctaaatattaccagctcaaaaatcccaaatcccattatgaaaatcatttaaatcaggcatgggtaaaactctgagtattatccagggcaaattccatttggtttcaagacccgggagtaatcctctatctttaaatattttctaaagaaaaattctcaagaagtaaaagagcatatttactaaaaaaacctttttttttgtatattgctgaacctctcacagaaagtttttctaccagcaatatatcttattagtgattcttctacctagccattctgatcatcatgttatcattatgtatatataatataaaaccttcaaactttgccattttcatatgaacaaaagcttaaaatgtttttggtgttagtgtctttttatattttcccttgatttgtctttactgctcatattcttatcactttttttctatttttcttgatttctatgatgtctttatatatttagagctactgatttttgtattgcaagagttttcccaaggttcaatttttttttagttttgttttttggtaatatactgagggtttttgttttttttttaaatacagtcatatctgctatgtttcctagtgtaccctttgcacatgttgtttgaatgtccttcctctacattatgtggaaaagtcatactgtactaaccttatttctgaaaatggatgtgtttggtcttcgtgggaattcacatgatctggtagaaaggaggcttatctttgaaagcagatctaggggccgtggcaaggagctctgtgctcttgtctctttgccatcttctccatccagtgtggctccgtcagattttcagatctcacatttacagtttgaaccctctattaaatcctcatccactgaggtcagaaagtgtttggattgcagagatattttttgagtagttaattgtataataaactctagagagtgagttcaggaaaaagtgtctctaaggtgaatgtgaaaccaagatatgctgcaaatgcttaaaaaattcagttctgttacaaggtatccttttaagtcctaaagaaatgattctgtaagacttattgatatagaaagaaatgttagtgaataaagcattttacaaagcattttcatggtctgatttcaattgtagtgaaaaaatacatgtccctatctatgtatagaaaaaagtctgcagtagttagtaaactgattattttgagatacttggattgataagtttatgtaaaattttaaccctatgtattgtataggtgtatatgtaacatttttaatatatttgatctttttttgcattttctgcccttctaccatggtggttttacttgggtaataaaaaacattggtatctcttcccttcctaccctaaagaaacagcttcatggaaataattatttagaatacttgtattactaacttgaagtttactctaccgtaatgtttttagcaaatttttcagattcttcactctgttgtttatattcattaaaatgagggaaaacgatatttattaaactgagggcattaagtataacactgaacagatggtaatatttttagaatttttcagtatatctactgagataattgatttttataatagtattttcacttgcaaaagtattaacttccctgaataatggaaacttgaagtgatagcattctatctattgtatcatagcctagtgaatgatttgtagttagtaacaactttagattattttattttttcttagtttaagaaattcctcattgcctttcaaaatattgtcctatattaactgtttgttaaagcaagttctcttgccttttggtgtgactttcttatgccctcagaatagtacctgttttgtagtacttgaaacttttactttttatttgttatttctcaggtaaacgcaaagcactgaagttgaattttgcaaatccacctttcaaatctacagcaaggtttactctgaatcccaatcctacaggagttcaaaacccacacatgtgagtattcttggtaatcaaaggctcaactcaagcaaagattttaaagttactgtattttatgaatttttccaattatgagatgtcagtataatttctctgactaaactctctgggaatattgtttattcttttccttctggagttccagttaaattgcaagttgcatttaggaaatttgactgtcttctgtccaactgtacaaattttcaccacttagtgacaaaatagagtcccatcttaataagctagattcctgcaagatttctatgtcatagtaaattgaaagagttgtgtacatgtgagtgtacacatatcagtggttatttcatttactgaatttttaaacaatagaaatgatattgtagcatcttagtgaaaatattagagcatcttagttaacataaagcaataccttcagaacaatattttacattaaccttcaattgaatttaagtgatgtgaaatattaaaaaacctcttcttatttcccatcctaacctatcatgaaaatgaaggccagtggctgtacttttataaccatgtccataaaaataattttgagctagtttcgatgttgagaactataaagcaagtggtgtaaggtatgattaaaaagctggcagatacatttttttttaagtaatttctcaacaatttgcatctagatcttattaggcttaaaatacatttattcttcccaaagaggcacttttattgctattttctcttctttcagaatttggtatgcattgtatttacaaacagtaacaaattggtagaaggtagtgtcttgcaaaagagatgcttaaaatatttttaaaacagcaatgtctagaagggagtagtttcacttgtagccttagagggaatgaaagatattttaaataaaaagtgtagtaacaatttatttttctcaattgtctattaattttattagactggtgttcataatcacacttcttgtcagagctcagcctagagtcccactctttttaccttctctgaaacatcaagtaggggctatcttgaggaaggaaacttagtacttattaattagtcagaatttcagcagcaaggaaacaattcttaaaagaacctccttccttatttcttagaatttgtagtgaaagctagtgcaaaactaattctttaacatagcccccttctgttaccttagttactagctgaaccatatgttggaagtctaagaaggaaaggatatagcagtaatcaccaaacttatcagatctttcttttttaaaagcctttttggacaaggagaaagacaacctgacttaaattaaaactggaaaaacattcatctatttgtactgtcttccctctggagtttctttatgtatgtggaattcatggagcaaaattttttaaaaaatagtaaacacagggtggaaaaaaactttcttccaaagttgagttcaggttttattttttgttttgttcttaactaatgttttataataaacctatagccagctagatttctcatcctttgtttcttcccagcaagtatttaaaatttgaaaggacatggtaataggtagttttaccttatgatagaatctttagagcttgattctggtatgtaaaaattttagacccagactttgttgtaagttttttattgtacaggtcaattgttctgggttaggaataggtaactactagcattgttactggtcagagataactgttttattacttagaacaacattatctcctctaccttcccagccccttccaaaaggtatccttttgtactcttcctctgagttgtttgccatcaagcactaaaaacagttgttagtttctgtttaggatgagtacttgcaattagaaaaacataacttgtagtttgtgggagttttgaaataagatatctcttaacatttatatgttttttctcctaaaatttccttgaactttaataattacagatgtgaatataaaacttgttcatgaatttaggaaaagataagatgaaataagcaagctaatgaagttaagatatgtcacaggatctggtttcagatctccttggcatttgatgtctcctggatgcaggatcctttgcaagattaaaaaaaaaattgtaagacagtgttctttttttctgagaaccaacagtttaaataaaattccaagaaatgacaattggctgtcgtaattttagtaaggcataaggtaatatggattgaatgtcaaattaaaggtgtacaaggggtaaatcattttagaaaacctacttgattaaatgcttcccagaagaacaagattttactggattttgaaagacaggcagggaaggttgagtgaagaagacaagggacagtggcattctggtgagcgtatgcacaagagaagttttgggaaccatgtgtagatctgtttaattgtagcagggatgttatttatagattacctatttctctctctcactggaatcttttagcctgttttctttattcttgatattctgtaattatatgaggataagcctcaaattgcatcatcttcccatgtatcagattaacccttttagtttcaagattcatgtatctctttttctgggaaaattgctgctgctttccttttgatacatttccttcatgtttttcctatcatcttctcctgaaacttgtgttactaggatgttggactgcctatatcccctgtatcctagactctaaaaaaaaatgtgttccgtctcattgttttcttactctgtatcctgggagattttctttattttccatcccctaaatggaatcttggcaatcagttttaatttccaagagttgattgtggcattttcttaggattctattcttaattttggatacaaaatagggaatttaaaaattcttttctgttgtttgaattattgatttcctcaaggatcagtttttcttttacctctttctcagtttttttttacatcttataatttttttttcatgtcttgttcttgattgtttcttgaatggaagctttggttatagatcatcacctggtgggcttggctttacttttctgtgagtattttgagagctagctcttaggccaggaatattaccaatgctagaattagtagagccaaaattcaccttaggaagcctggttctctccagatgtgtttgttctctttgaagacatgccccctttttattttaggggaagaataaagaggaaaagtggaattaactagacctttctttttttttttttttttttaagtggcagggtctcactatattgcccaggctggtcttgaactcctggattccagggatcctcccgcctcagcctcccagagtgctgggattacaggcatgaggtactgcgcctggcctagaacttccttatagaaagaagtttaattaactctggtttctaggccttcatttcttctgaccatgaattctctctgatccagtgttctattgggaccatgatttgtccctcatattcactgcatgcctgcctcctaccatgtgttataggttatagttttttctgtttatttttaaaccttttattatggaaaattgcatacctacccaaaagtaaagtggtagatgaatctgtctttactgtcaatcagctttaacagcttcaacagttaatagcatggccaatgttgttttatcttttccttcaaccccttagttttaaccaaatctcagatgttatgcaatctacaaatattttagtatgcatttataaaagataagagctgcttttaaaagacataatcatagtaccattgctacatctagtagaataaatctttaatatcatcaaataagcagatgacctcattagtttttttatttttaatagtttgaagtgaggtctatacaaggtcctgcattctatgcagttagctgatcagtcttttaaactagagttccttctcttgaaatcgattagtttttctttgtgatacatttttatctactcaggcattcagaaatttaattcttttaatttattgcttatttccttaaaaaaaggatttttggggggatcttggaggatgaggagacaacctgaacaggaaaccttgatttttaattatcaatgattaaaattagaaatatttttgacagaaaatgcatattataatagagactcttgtacccactaacattttttcccttggcttttaaaatgaaagattaaactggatagccaaagagtacaaagaaaaagcaaaggaaaaatgtgtggctaccttttaaattttcatcaggtttggattctactaaacactataaatctttttgatactctagggatattcttataaatgtggccagcttgtgttaaaatcatgttgtgtatatgaatttgacaaacagaagtagatattctgttaaacattctgtgttttcatgatagtgagttatggttgagtgctctcagtgtactgagtcgtttagaatatattcagtacaattgttattctgaaagaacatcccttttatcttcataacatatcacaattgtcaagaaaaaacactagcttaaaagttaacactggaaataaatagtggtggatgcagataacattttggggcttaagagttttggaaccacacgttttaagtttaaagtgctctctttagaccagaggatctctaggatttcccttatctttgtttattacattggaacagacagagactcagttgtgctatagaacatctaggagtagtttaaagaggtttcaaagtccctagttaataactaatattcctcgtatttcttgatgagccttctcagtagaactttatcttaaaacttagaatttcttcttctcttggttaaattgtgagaactgtgtcttataaacgttgctgtcttagaattaatgacgaggccgggcacagttgctcacgcctgcaatcccagcactttgggaggtcgaggcaggaggattgcttgagccaagaagttcgagaccaggctgggcaacatggcaaaaccccatttctacaaaaatagaaaaaattagccacgtgtgatggtgtgcgcctgtggtcccagctacttgggaggctgaggtagaagggtcagttgagccctggaggttgaggctacagtgtaccactgcactccagcctgtgtaagagttgagactctgtctctattaaaaaaaaaaaaaattgtttttaaaaagaaataacaatgggtagaaatttaggagtctggatttctatcctggtgttgtcgttatctctgtgtccttgactttatcacttaattctgctctcaatttaggcattgaattagaatagcgacatacactattttatataatgaataggaaggggagagaattaagccagccttgcactgccttctttaaataaagtctcatgtacaaaactgataggctaaaaagataaaggaggaactgtgctgactgaagtgtttgtgaggtgggagagagttttgtagcgttgtctgccttcattccccagaatagtcccaggacatctctggtggatttctaagtgtgaatacctctaatctacatgaatttggaagtttttttctgtctctgaaattttttgaagcaatcatgatactgtgaaatctctgcatttctgtggtggaccacttttacaaaatagcggtaatggtagaagtatttatgggtatgtattaatagatgatgtttaatctcaaatgtgttaaatactatggggtgtgtgtgtgtgtgtgtgcgcgcgtgtgtgtgtgtggctggtttggtgctactgctgcgaatcttttttcttactgtagtaaatatacataacgtaaaaatttttatcttaaccattttaagtatacagttcattgggattaattgtgttcacattgttgtacatttgtcaccatcatccatctctagaactttttcatcttctcagatcgaacttctgtacccgttaagcaataagtccttattctcccttccttctagccctggcgcccaccattctactttctgtctctatgaatctaactactttttaggtacctctcataagtggaatcataacaatatttattttgtgtctagcttatctcattcaaaataatgtcttcaaggttcattcatgttgtagaatgtatctttctccacccttctttttaagggtgaataaatattattttattgttatgtgtatgcagcattttgtttagccattcatctgttgttggacatttgggttgtttgtaccttttggctctagtaaataatgatgctgtgtttgggataatctttaaagcttagatcattgtacttcttaatgttacagtttagggatattcagtcttatctttagtcccacattccacctcagtgtacctgaggctgtggtacacttccataagtcagcaattcactggagaagtgattctcgacagaggtggcagtggtaataggagtggtagaactgattttctttgtgggcccctacccccttgagattcacattcccttcaagctggatgtttatagctgaggtggtggatgctaattctggaatatgtatttgcatagattaatgatacatgctgttgagttgtgtgcttttggtgttataaatcatctttgttcttgaatcagagactgaggcagacattagaagatagccctggttttttaacccacagtacttctaagtgctgctccttgaagatacatctgacttcttagctattgatgagttttccaaccatttctaatcaggcagttatgtttttgagttctgatttcaatcagaatattataaggccttttatctttgcagtatgtatgtttctggaaacttttatctattattaaggaaatttgctatatgaaggtaacttttttcagtgtgtttttttttaaattatctacaactgagtaacagtatgattatattattgttcttgagcaaatttgttttccccagagttaataactgcctcatatatggttcactgtgaatcttctctcaacatagttaaatacatcagttggtcactcagttctccccctctcccccccctttttttctttttttgagttagctatccatccatactcttgctttaatctggagtggttgcacttgaggtctgcttcacagggctgttgccattgttttgtgaatgcctgattctgattatctgtttccgggatttcatctttttttatttttcactttcccactctcattttggtagagtatatattctaagtcttcctgagataagaattctttcttagtagtttttaattatttctcaagctttttgggtgtttgtatgcctgaatatgcctttgtcttttttcagacaggatcttgctctgttgccctggctggagtaaatggtgctatcatagctcgctgcagtcttgaaccactggactcaagtgattctcctaccttagccttctgagtagctggcactataggcatgtgccaccatccctggctcatttttaaattattttgtagaggacagggtcttgctatgttgcccaggatggtctcgaactcaagctatcttcctgcctcggcctcccagagtgctggaattacaggcatgaaccactgcctggccttgaaaatgtctttaaataaataaccctcataatagatcagcagttttattgggtatagaattctggggtagaaatttttctccagaattgtgtttgtatttcgacaatgttttctattttccatggttactttaaaaggttagatgtgactttgattcctgaacctttgtatgtgatctcttttttcttttgtgatttattgtggggatttttctttttccccacgttctgaaatcttgctgtgtttgcattcttcccccccacctcccctcttcccttttcccagtcttctccctcctttccctcctccccttacctttctttttccttgtagtttgctctcagtggactctttcaatctagaaaccactctttcattctaggaaagacaatttattattattttattcatctgggatgtgtgttcttctgacattgctatattgattcagtgaaatcccatcagacttttaaaatatgtgtaatgtgacattttgattctaaaatatgtatgaaaatgcaaaggacctagctaaaaacaatttgtaaaacagtaagttgggggacttaaaacgacctgatttcaaggttatctgtaacacagtcagcctacaagtacaacctgcaagctacagtaattaaggcttggtggaaggatattaaggataaacgaatagatcaatgcaatataatagaaagtccagtagacaaacacacatgtatagtcaatttatttttgactgtggtgcttataatattcagtgggaaaaaaataggcttttcatagtgatgtaacaaactggaaaaaggtttgaaaggataaattttaatttctacttcataccatatgcaaaaattacctcaagatggatcattgacctaaaagtaaaagcaaaaactctataaagcttctaaaagaaaacatccaaaatatatttgttatctggcataggcagaaatttctttgataggacaaagaaaccactaaaaaataataaattggattttatcaaaattaaaaatttctgctcatcagaagttttttaagaaaataaacaggcaaggccaggcgcagtggctcatgcctgtaatcctagcactttgggaggccgaggcaggcgggtcacttgaggtcaggagttcaagaccagcctgaccaaaatggtaaaactccatctctactaaaaatacaaaattagctggacatggtgtcgcatggctgtaaccccagctacttgggaggctgaggcgagagaattgcttgaatctggaaggcggaggttgccgtaagtagagatcataacactgcactctagcttgggtgacaagagcaaaattctgtcagggggcggggggcggggaggaaagcagggaggaggagaggggaagggggggagagagagagagagagagagaaagagactagaagaaaacattcacaatgtatatatatatatctgacaaaggacttttgtatatataataaaccaaaactcaaaacaacccagtttacttttttgtttttgagacaaaatctcactctgtcaccaaagctggagtgcatcatagcttagcctccagagtacctgggactacaggcacattacatcacacccgactcatttaaaaaaattttttgtagaggtgggatcttgctatgttgcacaggctggttttgaactctccttaagtgatccccctgcctcggcctcccagagtgctagtattacaggcattgagccgctgggccagcccaaagaacccaatttgaaaaatggtttaaagactctgatagacacttcacaaagaaggcattggaatggatgataagtatatgagaaacagccataagaacattagtaataagagaaatgcagactaaaacaaaaaggtgataccactacacttccacccgaagggctagaatttaaaagaccaggcaatatcttggcaaatatgtggtgtaagcagaattctcctatattgttgaggaagcagaaaatggtacaaccactttagaaaactctgctaggtttttaataaaatgaaacaagcacctgcccctgacccagcagtcctaccttttgttatttgcctaagatgaaaatactctcagaaagatttgtaagtgaatgttcatagaaagtttattcagaatagccgccaaattagaaagaacccagagtgttcaataatggaagaatgaagaaacaaattatggtatattatttaacaaaatactcttcctcaataaagtggagaaaatactgatacctgcagtcatattgatggatctctgaaaatgctgagcagaagaagcgagacacaaaagagaacatactgattctatctctatgaaatctagagtaggcagaacagatctgtggtgattgaaatcagatcagtgcttgcctctggaggagattgacaagaatggcaccagggaaccagggaattttctgaggtgatggaatgctctgtatcttgctgtattttgtgaaatagaaaggtgtctgcatttgtcaaaactcattgagccacatatgcttatgatttgtgcatctcactctatgtaaatgatgcctcaattttaaaagcaatcctgaacaataacaattatatatatacatatattattattattattattattattattattattggtgtttgttgtttttttttttttgagacagagtcttgctctgtcatccaggctggagtgcaatggtgcgatctcggctcactgcaacctccgcctactgggttgaagtgattctcctgcctcagcctcccaagtggctgggattacaggcctacaccaccatgcctggctagttttttgtatttttagtagagacaaggtttcaccatgttggccaggctggtcttgaactcttgacctcaggtgatctgcccgcctcagcctcccacagtgctgggattgcaggcatgagccactgcgcctggcctaatttttgtatttttagtagagatggggtttcgccatgttggccaggcttgtctcgaactcttgacctcaggtgatctgtctgactcgcctcccacagtctgggattacaggcttgagccgccgtgcctggccagtaacaataaaaattatagtgatagatttttttactctcactgagcagtatttgtggttttctgtccttgttctcaaagcacctatgtatttcgacaatttagatgacttgatgaatatatgaacactgtgcttttaatgaattcagcttttatgcctgtggaacaatactgtgataaattttatttctgcccatgtggtttcccctttcataatgtttgaaagaaccctagagtgaaatttttaagaaggttatcaagtttcttttgagaattattctagagtatctgttgcaccacatcaggtatagtgtacccctaagtagctagagtcccctaaaaagttgaggggatgtgtttttagtgtgctttaaaaataacatttactattgtttctttctttctttttttttttttaatacagagaaagtataaagaagaaagccaaaatggcccattatcttatcatccaggtagttcatgttaccctttaaaaaatcagtagtacctgcttctggtaagagaattcagttggtgcagaaagttataaaacaaaaaatcagcttcatgcccttaatatttatctccaaagataaccctgttaaatgtaaaatgccttgcagaaaagcttattatatgtcagaatacataatttatatagatccttaaagaatatttacacacaatagcagtttttttctgcacttttttgtagcttgattttttattcacttagtaacttagtacatcttgaaaatatttctgaattaacacatacccttttcctcctcctcctcttcttcttcttctttgttttttgagattttctcactcttgcccaggctggagtgctgtagtgcaatctcagctcaccgcaacctccacctcccaggttcaagtgattcttgtgcctcagcctcccaagaagctgggttttaggcatgcactaccacacatggctaattttttttttttgagacggagtctcgttctgtcgcccaggcgggagtgctgtggcgtgatctccgctcactgcaagctccgccttccgggttcacgccattctcctgcctcagcctcccgagtagctgggactacaggcgcccgccactgcgcccggctaattttttgtatttttagtagagacggggcttcaccgtggtctcgatctcctgacctcgtgatccgcccgcctcggcctcccaaagtgctgggattacaggcgtgagccaccgcgcccggcccacatggctaatttttgtatttttgggtagagatggggtttcaccatgttggccaggctggtcttgaactccttgcctcaagtgatccacccacctcggcctcccaaagtgctgggattacaggggtgagccactgtgccccacccacatacctattcttagttatatagtattcattacattgtataggtgtattatatatttaactagttccttattggtagctatttagattattttcattgttgaattaaaaacaatgttttagagaacaactttgtgctggtgaaatgtacttttaaaaattaaccaatgtttaattcttcatagattggtaattttcagcccttttcttgtcataggagagactggaagtagctgtgttttctcgaccttgttactgttgagatactagattggaaaattctttgttgtgggaggccgtcgtcctgtgcgtggtagaatgtttagtgacagccaaaatgtctccagacattaccaaatgaaccttggagtgcaaatttgcttcttcttaggaccactggtacagcgggcactgcaggtttacacagatgaacctttttcctgactgaggagctgcagaagtcagatataagaggtgtattccttggggtttgaatggatgccagaaaaggggaatttggggaatggctatagggatatctcatagagtccagggagaacatcagagctttgggagcaagtcatagttgccagaaaccaaagcaatccagtatgtgttctttcatacatttagcaaatgtttgttgaatgtctgccatctgctagttactatggtgtgggcataggtatttcatgttgaaaaaagagatgtgattgttacttcatgaagcttgagatttagaggcagacacagacgtgtgtgtgtataaaattataatcacctacttgctattaaaggaagagaaccaggtgctatgagaaaatgaaatatgggcctaatttagaaggagggtggtgaaaatgtagtcaatgaaggcttctaaacttgagtgagttttactagatttggggaagggattgatgagtgttccaagtggaaggaatcgcatgtatttgaaattatcaaggtgggaaatattcaacttgtcatggaatggaaggaatggcagttcacatggagggtgactgaatgagaaaggaaaaacaaacaaatttagattaagggtgtagagacagttaggtatggagagatgggccacataatgtagggccttgtagataaagagctggatgacatccaaagtgcagtggggagttatggaaaagttgtaagtaggtcagtgatttacaatttaaactgattatttacagtctaaagtaattattctggctgccgtgtggactatgtactgaaaggaggtaagaatatagttagggagacctgataaaactatggtaatgtaggtaaagcgtaatagtcacctatcatgacttcaatagtattaaattgatgacagtacatgtagagagactgtaaagacattttggaagtaattaataaatattggtgataatttgaatgtagatgatgacaaggaggaaggtgttcatagtgacttgtagaattctggcttgaattaatgggtttagttgcgattactgtgatggagactactgggtatggagcatctgtaaataggggtcatagggcaagatcgagttttagataatatttaagtttgagggacctgtgacattttattagggatatcaaaacatacatatatatattatatatatatatagcgtgtgtgtatatgtatttatgtatacatgtgtttctgtgcttatgtgcatgtatcacatactctggtgttgaaaatatgagtctggtgccagaagtgaagttgtagattggagataaaaagttgaaaattgctgccatatagatgaaagggttgcctaggaagagagtgagaatgtattttgatgagaaaattgtgtccagggctgagccccaagaaaatctaacatttagaggttggatagaagaggagggacaggcaaaaattaaaagatgcttgataattaggaagcaaactggtagtgcatgatgttatagaaatctagcattgtttcaaagtgcagttgggaaggaattgtggttggctatgtctaatgttctgagaatgctagtaaagctaccttgttggcaaaaactcctgagatacactttaaactactcttaatttcttacttacttgggaagaggttttagctgccactggaaattggggcctaaacagggaaaggatctcatgaaaacatgtaacctatagatttagggcagttttccttaccttttcttgaagaagcatagcccagaaaaactgttctaagggtaaacttagagtacaactgacacaggatcagctcttaggaaacagtcaatagcaacatgatgcaaacatgaatgtttgtcttgtcctctttaatgttactcttttctgtggtgataaaacatttctttgtatgtcataaatcagtactacttcagaatactgcagacttatctaatttgtctaatacattctgttcactaaatatgagtatcagaatttgaaattttctatttagaatgtttgagccattcttctggacatttcatttttcagtttttccttttgcctcatcttagatcacagcaaagatactcatttgttggtagtgccaggaagcaggcagtttccatggtaactgacagaccgagtttactgtggaaatttccggaattaacagagctgcattgcagaaggatgcataaagcagtattcatctagagatcgtaacagtacggacacagaagaacagttgcagtgatgtgcagggtatgtcttacctttattttcctgtctaaggaagattagtcatatatatatatatatatatatatatatatatatatatatatatatatatatatatatatatgcatgctgaggagacagtaaaacagcttggggcgttttagtatatgctggcttgatacagtcaaagttgcttaggaaaaagaaggaagaaatgatttgggaaagaaggtatatttgatagcattgggaagaaatcaagatcagatgatcgaggtagaagaatgtgatagtgaaataagaggagaaaacatacttcaaactaattaaataataaaaggttcttacggatagtggttctaggcacaagaagatatttatttatttattgaaggaaaatagtagacattgtcaagtttgagaaatcaagttctcatgtgcaggaaaaagaaatctgttaagataattagctattacttgctgaaagataggtagatatgagagatgtccaggatattaaacaaggaggtttgctgccatcttagcgtacttacctaagtgatgagagaatcctagaagggtttctgcccctaattccactctctgttgattggtgggccattttcaagaaaaattctgaaatgtatcttgagattaaattctggaaacagaactataggatttgggcagataattgaaggtgcttatcatatagagcataattataaatgtaaaagagaaaaaggatatagaaaatatgatttagattatttgcatgatagatgcaatttaggttgctagataccatttggtatcatttatatcatgtagtcagcaaactacagctcatgagctgaatccatcctgtttgcttgtttttgtaagtaaagttttattggaacatagccacacccatctggctgcatagttgcaggagactagtggcttgcaaagcctaaaatatttgctatctggttctttacagaaaaaggttgtgactcatgatttagatggtgtactggatttttcaaggcttctgtgagattaccacaaacttggtggcttaaaacaacagaaatttattctctcacagttctagaggccagaaatctgaaggtgttggcagggccatgcttctcccgaaggttctgggggaggatcccccctttctttcagcttctggtactgctgctcttccttggcttgtggcagcataaccgtaatctctatggtcttcttccctgtgtctgtcttgtgcatctctatcttctccttttctttgtttggtctcctataaggatagttattttatttagtgcccacctaatccagaatctcttttttgagatctttaattttatccgtaaagataggttactttctgagattctggatggacctatcttttttttgtgtggtgggtggtgtatagttcaccctactacagatggtattgaagaactgggttttggcttcttaaatcacattgtatattaaggatagccagttcttagtgtttcctttgacctgctggagaagatattaaactcacatttcaaaggcaaggtgatagaggcatagttgaatcatagaagatagcctttgtgacacaaacataagcagtagagtaaagggagtactagaaaattcataggagaaagagtactaaaatattcactggagacggatgaagaccagtgcctgatgcttcatatcgttctcttcttgtctcttcatatttttctcaccctaactcccacctccaaaaaaacaacaaaatgaatttgaaattttaatgaaaaatggttggcacaaaaacaaaaatcacagttttgaggaatggctcatcgctaaattacggcactgggaaatatatatatatgattcaaaagaagtagacttaataagcaagtagaggagtggcagtgtagaaggtacacaccaatgtatagaccagtgaacctgagatttggcttttgttgagagcctttttgtcattgtgggagtatacaaactattggcctgggcaggagagaaggtctgtgacattttcctcttctcatatgggcatatttgtaaaccataataacagtggtaggtatctatttgcattccctggaagtctcatttactgtatttgggtatattctgaaatgtttaaaaagtgatgaattcacatggtgaagaatcaaatagtaggcaagggattccaatgtagacgctggagctgcagagaaaagccaccttatattgcctatattctcacctgcgcactttgaaatgaagcttctgatacagacttcatggagatgatcatagaagaattaaatagaaatggttaatccaaattagggttcactaagagtaagtaagcagttccaaactagcctaatatacttttttgaaagtgttactaggactgtagatcaggagtttggaacagactaggtgtatcttgatttcaacatttatgggcacagaggaggaacatgaagcccaatacagtattttcaggaagtttcttagaaggacaagagtgaagtctgcgttttctttctaatcaaattctgttagtctgtgaccatgtatattctgaatatcaaataggaagccatgggaatgaaagttttcttattttcttcctttaacaaaacatttgaattgtatgcctaaataccttcatagaaagatacaaattcccttgaatccaactacaattagacttttaacttttaatttttctgttagtgtcatgagtatatgataagaatatcataaggaactagaataaaatcaggtataaagcatagattgggattaaattgagctggttgatcatagttcacatgtacaggctaaaatttaagcagtataaggtactcatgaataccctagatttcaggtctttgtgttatgtaaaatacacatgttcctaaatgtgtctatacataaaatttatttctataaaattgttttccttttctcatcgacatgtttaaataagtgtctcaaaaataataaaagtaagcttgagggtgtttaataagtaggtgttcaaaacacaactcacatagtattaagaattagctaacagatcacaaatgaaaagtagttgagactcttggtttttaatttgctttaagaactaaatttctgactttgtaaaagcaatctgaggtttgtagtacaaaatgatatatgagtagcagtgtcctgctaaaatatttattaagaaacaaagatgaaaatatgaaacactgaaaattaagatgacttaactccctataggatctgataatggatactaatagtaacacagccagaataaggaaaatttttacccagggattcttttatagcagagacttcatcccttttcatgttcatttcttctcctgcccacactggtaactaccagaaaaaaactggggagagatgggaagagggaggatgctgatgaattttatctgggaagtgtcattatgagtgaagtgtactaggtggaagtagagaaggattgtagtaacagtatagtgctgcccagtatagacttaggattgtatttttatattgctgttatcagtccagaatacagtattagagaccaagaaaattggagagaggagaatttaccatgggagcagtgagtgctctgatttgtaatatactaagccttagatatctcaaatctgcctttgaaccataggcatgtaatgggcaaatccgtatcagacaagtagagtgcagcccaaggataatcttctttttctttctctccttctctcagcagttttattgaggtataattggcatagaataaactgtacatatttaaagcgtataatttgctaggttttgacatatgtgtacatctgtgatgccatcaccatagtcaagttaacatatccgtcattcccagaatttcttccttctcgttgtagattttttttttttttttttctgagacggagtctcgtactgttgcctgggctggagtgcagtggcgtgatctcggctcactgggaacctctgcctcccgggttgaagagattctactgcctcagcctcccaagtagctgggattacaggtgcccaccaccacgcccagctaatttttgtatttttagtagagacgggggttcaccatgttggccaagctgagctcaaactcccgacctcgtgattcgcccacctcggcctcccaaagtgcggggactacaggtgtgagccactgtgcctggcctcttgttgtagtttttgtgtttagacatttgatttggttattttttctgtcttccacgtctatatttaacatactctatccatcctttcgtttttttaatatatggaacgtggtaaatgtttcattgtctttattctagtatttttgtcatttctggtcagttgcaattgattgatgtttttctcttcactatgggtcatgtttttctgcttttttgtatactgtggtaattttagattgcatcccagagattattgtgtgatggctgtttttgtattttcatgaatgtttttgagttttgttctttggttaagttacttggagatagtttgatcctttcaggtcttgctttttagctttcgcagatgagactactctagagctaattttgccttactagtaaggtaaaatccttctaactactttattggtttccaatcaggaagctttccactccagtggctaagaataggagctgccttgtatgagcctgggtatcatgccttcttaatccttttaggtggcttattcttcaggcttgtataggttcctcacaatcatccgctgatcaaggagggccctctgcatatcggtggggttctctttctgtgtagctgtctcttatcctgtactctgccatgtgaactttggctaccttggtctccctagattcccagatccttgtccgcaactcaagggtactgccaggatcttcctggatccccgctccctgtatcacagttggtgaactcttcagcagtaagctggggacacttgtagggctcaccttacatatttccggtctttcagtgtctgctgccctttgtttcctgatgatttccagtgtcttccagattgcctatatattctgtctgtttttttcagttgttttaggtatgagggtaagtctgtctcctgatacttcatagtaggacaagtggaggtgccacattgacactcactgtgagatggaaacaggaattgtggaactagggaataatatcttgaagactttgagaaagagcatctccaaacaagatatcttgcaggattcaaaatagtttcttacaatagtgactgacattgttaatacagtgaaagaagtcatggcgtttataaaaatggattggaaaaatctcgaggagagaacagactggatggatacgcaacaagattatagaaagggggcagatgaggaaaagacataactagggacctgaaaagcagtggtagagtgaaatcccttttgatgcaattgtgaatataaatgatactgcatgacagcaaaagaaaagaatttgagggcagtcattgatttgaaagcatacaaattactgaattttttaaaaatgtaaattcataaacacaagggaaggtaaacaacaaactgggaaaatatttgcaatgcaggacaagggttgatggtgttaataggtaaggaacttgttagtagaagcagcgataacaaaacaaacacctgggccaggaaggctcaggggcgctatctcaggcagttaataataatacaaaaaagacatatttgttcaccagatagcttaagaatgttcaactctagcagttgaaaagaatgatctaaccctaacacctttcaaattggcatgaggaaaaaggtgctgttgactaggtacagtgggcaccttttggctgatagtactcctaaatcagtgcagacttggtacacagccattccagtagtgataaccaattatttaatgactgtgttaaaatatattaagtgaaatctataagcagtaggtataatatgctgtttttgcaacctattcccatagtatacaaagatacaaaataatatgtactaaattgttaatagtggtttttttctggattatgattgatttttccattttcctttttatcttctacctttgtagctttaggagggattttagattcggtgtctggttggaaaaagaggttcaagtactggtactgctgctgaatttgcacagcaaacacactgcatctaatagagggtgggagtgaaggtggaggatgtggctagagctgttctaataaccctacttgactggccactgtgtttctttacaaaacaaggccacctgcctatatatgaagttccaggcagctttattagacattgtatagaaatacagcttttctcagtgtccagtctgattaatgttctgggacattatgtcacagttctgtgtgtgtgtgtgtgtgtgtgtgtgtgtgtgtgtgtgtgtgtgtgtttagtctgtaggatttcagaaatttcagactagtagattagtctgggtcaatgaagggacaacaactaaaatacagtagtgttaattcagtattaaatttaagttaacagatatatttgtcatttctatccagaagataaattaataatcgggaaggacttcactgcaaacatgtagcctcaaaaaattagttttcagattttaatctaacaagataaatctctgatatcaaaatataatttctgtacattgagttgtacttttaataaggcctgtattatatgaattcatgccctatattaagtattctatctataatcttgcatgtttcgcaaaagttaggaccattcatatttcacttcttttgaatgtctgtaacacctgtggcagtttttctgggtgtatgtgcatgtgttttctctagaatgtggaactgttaagtctctgggaaccaagaattattagatgtggaatagtaaggcactgaaatcagggacaccagagttacggattttttgtgtgtttgtattttgtgtgtgtgtgtgtgtattttttgtgtgtgtatcttaatcaaattgtattgctttattcatgtgttttttgcagggtactgtggtatggactagagaacttggaatgacttatgaagaaaccttggaatgacacatgaaggatgataggaaagtcattctgaggcaggatgctttactgaattgtttttaaccagggtatcaaacatcaggaatgagttcaggagaacggaaacatcttaggtgctctgcatgttcagagaaacttctctagtaatgaactatagaaatgacccctgaaagtatagtcttagagttaagattctattcaaggaaatacttttggcctgttgctggaactgctctgtggatttggagacagttagcatcattggcccccagccactaaatgctgcttgcacttcccagtgattgggatgaccaaactgctgctgatgctggaggtgtccgggcactacctcctttgagaatccctgggaaataaaataatgctaggggctgtattaattaaaattaagtttgtttgcatctaaacaacaacaaggataggaacaaatagtggcttaaaccagatagtttatttcacttttccatagaaaagtccggagataagcaggctagggttggtgtagtagcttcactgttattggagtcaatgctattttctgctccatcattctcaggacattatttcagttctgcagggcattgagtgtggctggagctctagtcattacctacattccaggcaacaagaaggaggttggaggaaaagaaaaagagtcttttttccaactgagttagctccttttaagtactgtgttcctattttccacctctaactgcaaggaatgttggtgacttagcttggcctgcaaaataccacatactaggtggcttaaacaacataatttatttctcacaattctcgagactggagagtccaagattaaggtgctggcaaggtaggttttaacctgaggcgtcctgccttggtttataggtggccacctctcactctgagctcaagtgacctcttgtgcatatgagaagagagtgaactctgtggtctctcttcttgtaaggacactaatcccagtggattagggccccacccttcattaaccttcattgaaccttcattatcttcttataggccctgtcttcagtacagtcacatttggggttagggccttaacatgtggattttgagaggaaacacagttcagttcatagtagttgggaaatgtagccttttagctgggtgcattgctgccacacataaatgaggatcctgttagggaggatgaagaggagaatggatgttgggtgacagctgatagttactgccacagcggctgttgtctgagtttcccaggttggtaatgagaaccttggggttggaaccttatgtagtgttcattggaggcaggtaagggtgatctgtataaaataatgcacagaaaattatgaagggaaagatgagggatatttaggaattatttttattttggggggtacatggtgtatatatttatggagtatgtgagatgttttgatatgggcatgcaatgtgtaataatcacatcgtgggaaattgggtgtccatcttctcaagcacttttcctttgtgttacaaacaatccaattgtactaggaattatttttgataaaatatagtccccattctgaagaaagtgatatcccaaggaaaagtcagggaactttttttttctttaagagtataattgtaggcaaatatttatgaacaagtaagggcaactttacatctttattggtttgtatttttcaccaatcttctcattgggtgtgttttctactgtttatgttctttctttcctaggcctcttacgtagtttaggacagaaattgattgactccagagtttaatggaaaggttctggtccagttcctgtatctagtcagtccagtgctgtatctgtgtatagtcctgtggaagccattgtggttgtacctactgttaaagcaattgctgtgaaatggactcagttttgctggaaagatcgctagcccagtataaagacgaatgtatgaacatgccttggtgatgtcataactgtggcatgtttttctgtggtttttacagcactttttctttctaaatgagaaacttggaactctgggtaggaatcacattctcctcttttagcagctttgctgagatgtaattcacatattctgcagttacacatttaaagtgtatagttcatttgcttttagtatatttagtatatttacagaattgtgcatctgacaccttattcagtttttggatattagcccaagtaggtaccctgtatcacttcgctttcaacttattcagttttaaaaagaaactacagtgagctaaactattagtagagatattccataatactaaaatttgatctttaaaataagacataatattgtaactgttttcattctgtaatttctatatagtaatgaaatatctttcatttcagttctcaagaatgctagcataagtattatatagcaatgtagtcatgagagtcatattatatcatctttaccatattctcttggttagaggtaagtcacaggtcccactcacacccaaagaaatatgcctacacaaaaatacgaacactaagaaggtggggatcatgaggacttcctggagcctgtctgccacagcccttcaattagcgaacactgtaaaaaattttgcttctgatttacaagtaattttaattaactttttttcagcttccctcagtggtagattggtgctgtatatttcaccagtgattttgccattgagatagtatttacttgccaaagattatagaacaataatcattatacatggaacttcttcatgttagaacttttttcaggcttaatctgtctacttcatgaaaaagattaccaagaagagtttcctatttttgcctagacctgatttccatcttaaaagatcagttccagcttcatcttcacctaaatggtcacttatgccactgatttccgggcttcttgtgattctggatgctagagtatcaaataatatgggtgaaaggactttgaactgaaaagcacttgtatgaatgaaagcttatcacttagtatgatttgaaagtctgttatttggaacactgatttagtaaattgttatttagaccaagtgtatgaatctttgaagtgtaactttgaaccttaatattagtacatacgattattctcagagtgggggtagattttaaagttctaagttttttgggaaccttaaaggttgctacagaaaaccattctactaattggagaaaactttcctaaattttggaagaagaaaaataatgaccaagcacataaactttgcttgtttgcatcataggatcagagtttaaaagagatcctgatcatttagtatgaaactgaaaaatgtagttgatatttaatgaattctttcattgtgtgtatggttgatagtttgttcctacacattggggtttggtgtgtgtgtgagagagagcaagagagagaaacagattgattttacatttttcattggatttacttttttacaaagcatggttagaagttattaatactttgatctccaggttgagattttggagatgattttttatttaatggaaatatgtaatgagtgagctcttttgtctacgagccactcattttttatcccattgctttatcgaacgagggctgaaaatttcaattttgaatagcacatggcaattttcctcttagagccagctagctattcagttaactgttctcccacctcaggatggtattaacaagaacaggacagtatactaaggcactagttcccaaacattactggaatcatctgggggtctttaaaaatactgttttctgactcctgtccctggataattcagatgtaattgctatgggacgatacctgggcattgagatttttaaaatctcccccaggtgattgtaaggtacagcaaaccttgggaatagttgtactaactgaagattgaggcactggaataactaatgttgggtaagatagggtaagaactttttcgcaataaggtttgcagctcttgggattctcacttgataatgctgtttggataaaccatcatccaagtttgaataagatcttatatttagaaatgaaaactgatctgcagaattagtttaatcaataaatgggaatttttaaaaatcttcttggcaatttgtttttatgaatcccgttgaagctgtgtctattgactacctaaatctagatcattcttaatccagtgtgtaaaaaaccaggatgacacaaatgaaaaacttcaaaaacctggaggtcagactattttagtaatttagaaaacatttttcccacacattaatcagtactaaaagaaaaaagttaaaacctatttaaaatgtggaaaaattgcttcccaatattttaacagagagagactgagaacacacagcattgagtcatcaggaaaactgaagatctcccctgaacaacactgggatttcactgcagaggacttgaaagaccttggagaaattggacgaggagcttatggttctgtcaacaaaatggtccacaaaccaagtgggcaaataatggcagttaaagtaggtgatgccatgattatttttggtactttaatccattaggtgaaatttcatggtgcagtaataccactgttgttgtgttcctacttttgtggtaaatgtgggtgtttaaaaaattgtttctccaactcctttgagggtgttctgtgtagaggtttcttattggtggcacattttctatctctttggaaacatgagtgtatgaagtgtgcatgttgattgcatttttggcatgatgcattaacatgttttaaacttcaggcccttctactgccaaggtgagttcaggctgggcggctgcacccctgggagcagggcagtgctgcactgagccaggcgggagctggaagaagacgcagcacactgggttgggcaaggtgcggggctagggctaacagcagtcttactgaaggtttcctggaaaccacgcacatgctgttgccactaacctcaaccttactcggtcctgaccggctcggcttctgtttgtttatttcatctctactcagtactgccctgttccctggttttaaagttgtactgaaatgcataccttgtgataatgttgtcacattttgtccttattgtgtcgtgccacttaatatgttcattaaaaaaaaaaaatggccagaaacagagatttgatccatagacaatacctggcaagcttatgctggtacctgtaaagaactggtggtttccatctgactcctagtttcatgtaattgtaatttattcatttgtttgtttagatgtttaacaaatctttgctgtatgtaagatatttcaggaaaatcagcaacagggggaacaacttgcaaaaacaaaggaaaaaaagctagctgtggccataccctctctgagcttaaaattcctatgggaacaaaaatgtttcagtttacaagaattcagaatggatttgcatatagtccaagctaatcatcttcctattagtgtcctattttgagagtttgtcagagtggttgataagagtccttagttttttcttgacatttgagaatgaatttaaattaaaataaaatgctttctgtgtagaagtctgttgtgagccaaaccttactgtaactattttagtatccttcactgttgagcatttctttttgctgggtcatatgaaagtaatgttaaattagtggtagggaaaatttttatgattctctctatgggttcctaacattgtttttggctgtatttttaaaatgtggtgagaactatagacttttcataggcaggtgtatatacacaacattttgtatacaaaccgtagacctctaaagatgcacaggtgaagaactctgcattatgtgttaaaataaaatgttttattggaatgtgaaatgatttctgtattcctattttgtgccactgcagtgtaagtggaaagagtcattttatttagactcctggatgaatgttgtgttgtccctttgtgctacctgtgtgtgacatccagttttagttggctggatcttaagggaaaggtttcctatatagttaaagttgtaaacttttctttcaggtactagggaaagtaattttaaaaaattatttcctgctttttacagtttgtgttatgtgtgcttcaactttgttgatgaacattattaaacattttagtaatatggattgattttagccattgttaaaaaggtcataaaggtaaagagggtacttccttttgacacttaaaagtttttctcactgattaatttgataatattttgggttgtataatgcttactcaagttttgtaggaattcaagaatgaaaataggaaattgttgtccatcatttgtaatgttacattatcagtggctactggctactgtgacagttccagttgggatgctattaaaaatcccagctgtacttgaagaactttcaaggcagtcatgagacctacaaactggttgctgtcacatgtatacccaccacatggtactacctagcttcgtttaccatctcgaattcttgaacaagcatagcagttggggatgggagaggatggcagtacaacacatcaattaacatatagttgaggagtacctttggattccatgacttcattaatactggaagaataagtgtttttgcattaatatgcattaaaatttgataccaattgatgacagatgtatgccatctctgaattaaagaatgcatttattattggtttcttcaaagaagaatagtctttcatcacacttgagagagttcattcattcctcatttaggtacattgactggattgacaggcacaaatatacagaatcaatgtatgattaaggaggtgtttgatttgagactttacggttttaaaggaaccatgagacggtggttcacacagctgagagctttccattgctgttggtgaaatgagaaacacgcttgaagtaactctgtgctaacatcttaatacacactttgagaataaagaaggattgcattattagatgttaagctggaaatgatccttaagatttacttgcaatatctgtagaaaagtgaactgtgatattagcttgatttttttctttgtattattcctcatttttagttctgaggaattccttccccaaatttattttgccatatataagaaatatttgaaaaaggtgacttcttagtaaccagagttaattaccccaaagacttaatctaaaaatcagttttgatataatcagatttagtgaggtaacattgtaagagttatacttaaaacaattttttgatgtttggtttgaggacagtctcccaagctatcggtgagtttctgcattaggacctaagatgtgaacatggtttaccctttagttttaattgcacgtgcttgggaaaagggtcttgctctcctgtgagtgggagtaatttgtatacttgtgcctgaatgactagtcttagggctgcctagggcaaagccagtgttgcctctggggtttcttaaagctcagggagaacaaccttcaactcttaccagggatttacttctaactgtgatcagtatcctttacaaataacatttatttagtgtcctgttttgcacggtggtggggtaaccactgaatgaaaacattagacatgaacagtcactgtcctctacataaagtaggtgcctgctcagctctctggcaggtggaaatgggagaggatggcaatacaacacatcaattaacatatagatgaggagtacctcatctatatgttaaccagctctctggttaaatgtagcggggtaaagcccagagttcagaccaaatgtttgaagaggcagttaggattaggtttctgagctagggtaattcagatctgggagaaacacctagcatcatcagtcagaatcaggatgccacagaaaatctagggacacaggagaaaagagagtaaatgaaatgtcacagcttagaccatgggcttacaagctcagatggctgacagagggaagaatgactgtaagcctctgatgcctgacagtatattctccacctgactctgcctgcagtgtaaaaaatcctgcatgcctagagtaccagcttccctgttgttttctagcagactcatgtccagattgacttcttgaaggtatgcatgcccttttcatgtttgtagaatatgtgcgaaaaaccaaagaaacgtgaaaaagtaagaatgaaaatgagagggagtataaggactgaagtacctgtcactaaagatgatggcaggcagtggaatctgaattgttgtgtgaagggttaatactgtaataaagctgtcatctcattgaagaactgaataatattgagcaggtaggtgggaataagaatgtgtcatgttaaatttgtcattgtggatcattatgatgacttttcagtcttctgcttgagaaattatctgggttaatcaggaaaaacagatctgttgtttgagggtaggtgcataggccggactgagttagcaatgtgacctggtatgcaagagtttcaagtattttctttctgttggagatctgcctaacttgtcttgttcttttgaacctcagctctaccctttcacctctactgtttcattgatgtgagtcttgctgattctggcctgttaacctgattttgattcctgcaatcctgcctctccttgattatttggattttgactttagtgtccttgacctggagttgagacccagcctaatcctgatgcttgatagtaaggactagagccctctgctgacagtatcagcagcccacagctcagctgttccctgagtagaacggaactttaatctgctggttgagtaggcctccctggtgtagatagtatggtgagtatgggaagtcaggtatcagaaaagtatggcttggcttgttttcctgccactggagagaccatgccacttctgtcaaaagttccattaccaaattatttcagtggggattatgatgatgaataatgatttgaggaggttcattttagtgtttaaacattggtcttgcatgttctgaaagcactagaatgatactgggatggccttcaattggaaaagttcctttttgatggcatagagtgctttgttaggccattttattcacttccaaagggccgcagtgatcatatttgattatccaaatcacctatgggatgcagatgtcatggctcttttgtttagaattgagactgtagtctaatatcttaggccgtcgttcggtcagatcatgtgacttacttaaggcatctgtgattgagctgtattcttttatgcttcctaatattgcttaaaagctgtggtggtcatatgaaaagtgtaagtagagcatttccaggaggagacatattcaaggggtgtggcagggctggcctctaggcagccttgattttgaactcaggttgcttatgtagatggggttggaattcccagtatacatgtgtgcttgttttgctgtcactccaagttaatgtttttcagactgtgagtttgttccattaacagaattggatgtgcaacccaagaaataaaacagccaaaatcagtactgttcggggttatgtgagggtgggaagcagactctacctgcagccatattggaagcccttggggcaccagctctgaggaattaataggggtacaattaagacagtttggaaatggttgctctaggtgaattttagtcaatcattatatgtttttgaacattctaaagatctggtttctgaaaccttctaccatcacttggttaaactgaatgaattttgacattggactaaatcccaacttacatagttatctggagaaaaacctgttttttgttttgttttgttttgttttgttttgttttgtttttgagacagtttcactgcgtcgcccaggctggagtgcagtggcacaatcttggctcactgcaacctctgcctcctgggttcaagtgattctcctgcctcagcctcccaagtagctgggactaaaggcacgcaccaccacacccggccaatttttgtattattagtagaggcggggtttcaccatgttggctaggctggtcttgaactactgacttcaggtgatctgcccgcctcagcctcccaaaagtgctgggattacaggtgagagctaccacgcccagccaaaaacctgtcttaccatacctcactctgcgtgggtgtcatttgaaccagtatgtgatatatttcctgcatattttctatcattctttgtcatcttatggctatgcctctgaaatttgttgtatatgtcagatttctattgttacctcactttattgtcgtaagtactgaaatgatgatctgtcatttatggtcttcagacccttaaaaatttcagtgctaagattgacattgtttctttaaatgtggatgatgtggttagtaaagaggaagaagatgataccactcttaccaaggcatgtcaaacttgttccattaacttggtcctcagggcagctcttcccataatgtaatataacacatgcttttggaactgaactcccaggtgctctgataatacgtagcagaaggtaaggtaaaaggaattaagtggatctcagtatccccagtgagaagaatggggtattactattaattaattaattaattaatggggctaagatacaactgagagtttattaaattgattttaaaagacttgaatgatttttgcaattaagaattagcattctttcttctgcccgtagtaaaatcatatatgctttcacaatttaaaataattgacttaacagacacttattttttcacaggaaagaaagatttacatctgtgatcagcattctagataatttgcttgcttcttttgctgtttgttttggttaatgttgccatctgctttgaccttattaatgatggctttgtgagatatcatggccattttcgtgtgtgatctatttagaagactctagctgataaggaggaactcgtaccacaaattaggaaaataagaatacctaagattttctgcagcccagaggaaggtgataggatattgatgtgctgctatggtttctaggattttccaactttggtttctaggattttccaactttgtattacaactgaattctggacatttttgctgggaaagcagcatatttgtagggttcagaatagtagggacactggaggagtgtgatccttgctctcctatcctctacatcactgactttggttgatctgatgtcaatcattgactagcagtggattccccttcacattaatgacagtaaccttaagagggatctttagcagggattacttaatgaacaatgaagggtatgtttatggcatagcagtattggtgtttgtagatcacagaaactggatgcgttttcaaaatattacaactgtgttgtaatattatatataaattatatataatatattacatataatatatattaaatattatacaatattaaatataatattaaatatacaatatttaatatattatctataatatgtatgtaatatataatatatattaaattatatctaatatataatatatattaaatatataatatataatatatattaaatatattatatataatatgtaaaagattaagataatctttgttcttttcttcttttgatttttaatgctgaacctttgctatatcactctttattttctgtggagaggaggtcccatgtgctgtgtttgctcatgtactagttctaggatttctgcatgggtaattaaatatttactaatatctacctggtacaaaaggtggacaactgtcatcatagggagcttttgatttgcttcttgtcttgggtgtggtggttttagccatcatataattggacaggacaattggcaattacttgaaatacagaatacagattcttttttttttttttttttgagacagagtctcgctctgtcacccaggctggagtgcagtggcatgatcttggctcactgcaagctccgcctcccgggttcacgccattctcctacctcagcctccccagcagctgggactacaggcgcacgccaccacgcctggctaatttttttgtatttttagtagagacggggtttcaccgtgttagccaggatggtttcgatctcctgacctcctgatccacctgcctcggcctcctaaagtgctgggattacaggtgggagccaccctgcctggctcagaatacagattcttttggtaaccttagatgatagtaggtgcttatgtaggggaacaagccccctgcactgaagtatgggttttagctaacctagttatagcagattccacatagattgctgaagagtaaatgccttctggtattctgattttggttggtggtaaattggaaatgatgctttgccttgctaatggccaaattactagtagcttgcattattttatcttgtgtctatttgttttaattggtgcctggaagaatctctaaagccctacactgatttcctctaatgattgaattcgttaccttgctgagtttcattgtgtctgagtcctaatttctgatccaggaactcacctgtcttttactttggaatactctacctattcctaacttctctaagcagctacaggtgtacctgtgcagcagggagatgtatctcctactctgctcttactgtctttttatactgccctctcggacactcagctgagccatacaaacacctgacaagaatttgtcatgtgagaatttagagatctgccaggactgatggtcatgtccttccatgtcagttttcccatttcttatgctcctcacatctcattcctccatgcattgtctccattttaaaacaaaacaaaaatagcatcagttagaattgatagccattttgtaagtttatttgattatgttgctgttttcaagtgtgtctgtggcaccactgctttctaaagtcattttctggactcctcagttcttgattccttacatgtttgctgatgactcatatcctttttgcctagaatgttcagatcctaggaactgacatctgtcatgtcctccgtagaacttctgtttatgaagtgcatatatgacttgtcatccgatccttttttactcttgagtcttttgagtatataatgacctattattttccctttctccctgcaggaatgggatcaggtaacccagagtgcctcttcacatacattgttcaagagcttaacttggtaggaaggaaaactgggttatttgggagaatcagtagttgtcacatcaggacaccggcagtcacagaatgggtcatttcaaggcaggccctggtgctttgggataaggtgtgtgctgacctctctagtaactgagatatctttgagcaccctaacatggagatgtaagggttaactctgaatcagggtgactggcaaggaccactatcagaatcagccaggtatttattgagcatctaggcacaatgctacttggtgacctgcttcttaggaactacaacgtgagcctttattttgcctcgtctgcaactccatccttagcctttgcgttgtcagcctgccttcctttgccacacttgagtcttcctaaccttaccccttaatagcaatcacttcatcatcatgcgctttcccactatcccttctccctgtctcttcccacccatgaaaacaaatttagaaaatgaagggaaataaacaaacaaacaaaaagtcaccattatgatgggattgaggcataatatctgagtaagaagggaataaattagttttccttgacagtatatactgcctgtttctgtccatcctcttatttgcttctttttctttgctcttccactccagtccttaagcgagtttagttttattcgttcctcttgtcccttttcatgataacaatgtgtcatagtctgctttaaagtttttcatacttaccgatgttagttttattgctagtcattcatccctgatgagcaccaacaaattgtatgtgagagatggatttggtagggtttggatatgaggctggagaattgtgtcactgtgaagagagagctcccctggagatctcagtgtaaagttggaggacacctagaacagcaccacatttacattgttcttcagtatcagtaaaagagttatttatactttaaattcaagttgttaaaaatggaggcattccacatgaggctaaatattattcaagattttggtccatcgatgttataagctgtcaacatttaaatctaccaatgacttccaggtgccatgttgcacaaaaagaaggaaagcagcctttcaacaacttggaatttgggacatttctatatgattgggactgttcaccaagtggatgttgctgtgttttgtgacgagatggagtagaggacaaggggatcatttgtaactgaacatttttagcttgtcctatgggacttgttaactttctattaccgcggcctaatccatacagaactcccaacaactaaatttgtggctgatccaaccaatggcatgagttggactgacagttttagaaaaaatacgctttttggaatttttttttaattggacaagaaccatgcataatattaatagtcttaaagccagagaactgggaatgtaatctttttttcctgtgtctctaagtgactctcaattggagtgatgttggcatttctgacctgtatctacctgctgtttttattggcatttacctgctttattgggcttatatgcaatcttgaatacagatttggacaccaattaaaaaaaattaacttcaagtttataaatttctttactatagaaaactacttatatatgtagagtagtaatttttgttttgattttcaatgttttctttatgttatattccaaataaagtaaaacttgaaataatctgaaaatactttttattattgggaaagagatgtggattctttttcaagaaacacaatttaattttcctggaagcgtgtaataacttaagctaagttagtaaagtagtgttaagtaaaagagctcagtaaccccataatgaaaaagaatgattttgaaaataatataaaaaacttaatgttcttgagttgattttcttaagtattttatggtttcctgtagttttcattctactatttactgccagggaaaaaaaggtttgctgagctcaagtaaacagccttatctaacttttaaatttatataaataaatgaaattttcctgctattcaaagttttttatcaatggttgttgcttctgaacattatgattatgaggatttcaagtcatataattggcgtcaccttgttacttccatttttctgtgctcttaaggacagctttataaagggaagagaagtttgttcttattgatgttcaatttttaggtagttatgctcctttaatgttagaagatcctggactcacttgattcaaatgtagaagtctttcccatagatattgttttgatggttcattagaaaaactttcttggtagtagctttagtctcttaagtattctctaatttgaattgttgattgtcattatgtattctacttgagttatttattgagttattaaaatcactaatttgaagttactgctattataggcatgtgtttgtagttgatccccttttggggtcctttaggccttttgaaatagtttattaattcctcacatatgataaatgttacagttcaaccctaaaacattagtataattaagagttagcaggtcggtcacagtggctcacgcctgtaatcccagcactttgggaggccgaggcaggcggatcacgaggtcaggagatcgagactatcctggttaacacggtgaaaccccgtctctactaaaaatacaaaaaattagccaggagtggtggcgggcgcctgtagtcccagctactcgggaggctgaggcagaagaatggcatcaacccgggaggaggagcttgcagtgagccgagatcgcgccactgcactccggcctgggcgaaagagcaagactccgtcttaaaaaaaaaagttagctgtatttgttcaattccaaacaattcagatgcaataccagcagctacttttctacctactgccagatacttagacaaaatgttcagagaatgtggggaggtgttgatctcttgaaaagcacaatcaatttcatgttagactagtaggccattcagctgctctgtgttctattttgtactaaagtgacattaaagaatacttacagatgaataggttttcctgccagtgctgatgatctcaaagatagagctgtgctaggaactctctacattctgattagtaacaattctgtcagagattgtctcagtgttaggtatcagtaagatgttggaacttcagttaggcctttagatcatgtagtccatatatcctttctgtagctacggtagggttttcggacacaggctcgctcccaaaagtcagttattgatgataactgttgaggttttgactgtaatatgcttcctagttgaaatataaatatttgtacaaatgtgtatttagcataccacacaaccagttttgtgaaacaaaagataaactagtaaagaggacaccttttaaaaatagtagtttatgtgtgttagtatatatccatttgccaatatattcatactagtaaaaatagaaaaaaatacatttgttaacaccttttaatagtgagaggtagaaatcttccccaaccaaagggttatttgatttttcttctctacttgtctctaatattaaacaactcttcgtctgttttaaatttagatatataggattattaagattcttttataaataattaccttcctaaattagcattttcacagctacacttttagagttattttttaaaaaacaggtataaaggtagaatatttacaaaaattattacatcatgctttgaacaaatacagatcacatctctgggctattttgacttttaaaaatatcctttttgagcaaacatgctgaagttgatttaaaagtaagattattaatccataaactatgaaaataatcaaaatgagaaagaagggaaactttccttaacgttaatagaactagtcttattttgtttccatttttcattcttactttagtgcttgtttatctgagcattgatatttaatataaaagttgtaggtaaatctgtgtctgtaacatagatgccagttactaaattttatttgcttatgaaatactgtaggtagcaagctgtaaattttaagtagcaaaattaaatttgtttggaatatatggaattcctcaaaaatgaaacggagagaacctacttctgttccttaaacaactgcttattctcatgtcacatgaaatacatcttctatatctctttgtgcctctggcttcttttctgtaaaatgggctcaagaatttaattgactgccttcatccctttcaagaacatttgacagatacttcgaagtctttggaagacaaaatgccaccttgtgtattttttgatactaacttgccttgtaagtacacactatgtattgtacacagtggcgtgatgtgacattgtgaacttttttatgagaacagaagttgtttgcatgctttgatgttaaactataattttattattatttttttataatttctgaacatgattctttcctatattgtccctcccaacacctctgtgttctatactgttcctgaataagaggtgggaggaggtggggtacttaatgttttctggcagtctcttagaaatgtgcaaagaaattgttgtacagcttggttaggaatatatccctggtctgcagtatatggaggagcgctttagcaccttaggaatagacaaaaagagccctctgtttcctcagttttaggttttcttccacaggtttatgctgccctacatgctgactcatgggttggagagtcaggtagaactttttgtttttaatgtatagaaagtgcagttaaaggacagagtcccaatctaggattttggagacctggattcttgcctggtgcactgctcctatactagtattcactttatccggttctggactatttcccgtctttatgaatgaggacactgtggtatgagtgtcctcatgagtgaatgagtgaagagggatgttcttgcattgaatgcctagattgcatacaattttgaaacggtgattaaaagtatgtatacagctacctataattattcatatgaaactgttaaaactcattatcattttctttatatttgcatgtgggggttaatttttactgcctaagaactttgttgcataactcccaacattattagtaaatgctcatggttaaattgccctgtctcctttaaaggatttctaagtgctgtttgttaaactttctgtgattaaagtaattcttgtgaagtataaggaaagatgataattttcatatctggtatttgtgaagtttggtaatttttagtctcgtaacggtttttctctaccatgagactaaaaattattggtgtttttgacaaaattattgtgtttttttgacatcttttgtcattcttttccagagaattcggtcaacagtggatgaaaaagaacaaaaacaacttcttatggatttggatgtagtaatgcggagtagtgattgcccatacattgttcagttttatggtgcactcttcagagaggtaggaataaactgggttttagctgactaatgaatatctaattgggacaaatgaagatggcaggattcgattctattcttaaatgccatacattagtaataagttaatatctcagtatcttagtgtttaaccatggtaatttacatattaacttctgactctttttgcggtggtgggtaaggggtgaatcacacgtgtgtttgtgtgtgtgtgtgtgtgtgtgtgtgtgtgtgtattttagtattggtggctgtcatttgtaaatctcatacaaatattttctgttctttaagaacctgaaaaatcagctgacttctaaatatcagcacttttgctatagttttagattttcattgggccttgagcaacgcctcccccccccccccccccccccgccgccaactttatattttaacttttactcatctgtcatcaagtgtatgtctgcatttaatataaacacttatgtgtccctgcccataatcctgaagtatacccatcagacatggaaattaacaattacaatataaattatttttttctaattctcttatccagatttttgtgtagaaactaaagctctaatttcttggtctcataatcatgtttcttcttttggcctctggttattttgtgtcccaacttgggttatcatttctgcctccagctctcaatccacttactcatttccagtcatccagctgcctaaaatgtggaagtgagtttgggctaggggtagaactggagctgtaaatgaattaatacattatgatatcctagaccgccatcaaaaattgtgatacttagttgagtaggacttgaactgaactgctaagcatttcaaatactctctaaaaaaaatacctttctcattttgcaaatgttaggatgaataaccgagttgttataaactggtaagaaaaaccctcctgctctcttctttttgggatgggattatagagtgtatccttggggtttttgttgttattggctttaaaattaatatatatttttgaaacagggctgaatgtagcactgagtagaagtatatgcaatcttataattggaaacaatgttagaggttagttaattctaaacctaattctgaagtttttgtttgtttttctgggctcttactaggtaactagtaacaacacattctgcttcatgacagagcccatttctttgttgaatcactaattgttaattctcaactcgtagtttttttctattcctgtctttaaataatgagaatattcatttttatgaccagatatactgaatttattaattttcttccatcatttcacatcagcattccgttacatcagtatacagtcatgtattcatgtgcatgactgtatcttggacctaaatattatgtaatgttattctaaatgtttggaactttcttcatgttgcacaagaatcttaccatatcttcctccctttattcccaactatgaacttttcttcacgatcattaaatcatcacaccatatgcagaacaatagttaattagttaattagggactgaactagattttctctcctaactagattctgtggtcaactttttcagtgctgtattcgttttcattatagactttccccagctctgcctgaaccctaaatcacctccatagtgctggaatataccaatttatttcatttgttcatttatttaatcattcatgtaccatttacacacctagccttgggctagatagtgtgggaatctgattgtatgaaaagaaagcagagtaagtcatattcatgattgacaaagatgtggaaacaaagcacggaagcttggagtggtgtctgaacaatattcccatggttttgttatcatggatagctgagtcacatttggttttatgtctcagaaaggttgaagggagttgacatatgcagctgtaaacactaacgtctgttgaatgctttgttgttttcacatatgttttcttcccagtaatcttcgggatttggtggtattatctatcccctttttccagataggaaaatgaaatttagtgtgtttgacaaaagttacacagccaacaagtagcagagatgggattccagagacagaaatcttgctgttccttctattttattagaagtggtccagatatgaagatatatatatgctttttaaataagatttttgacaggataagatgtgtgataaggtgaaggcttaggaactacacagttaagctgtacaaagacacaaaatacctaagtagatgaaacatgaactttcctcccaaatcagaatgcagtctgtaataggtactttctgaataataagagttttagaaaagcagaaagtaacaacttttacaatagtatgttttacaataaaaatatagtttttcaatagttttacaataaaagtgtagttttacaataaaagtgttacttttattagtcacctttaaagagtgaatagtaaaagtgtatttcccgaagttacaaaggttaaaaatattaaaatggccgggcacggtggctcaagcctgtaatcccagcacttcaggaggccgaggtgggcggatcacgaggtcaggagcccgagaccagcctggccaatatggtgacactgcatctttattaaaaatacaaaaattagccaggcgtggtggcacatgcctgtagtcccggctacttgggaggctgaggcagaagaatcgcttgaatccaggaggcggaggttgcagtgagccaagatcatgccgctgcagtccagcctgggcaacagagcgagactccatctcaaaaaaaaaaaaaaagtatgtgtgtatgtatatatatatatattttcatatatatgtaagtaataaacagattgaataagactttaaagaaacatttttgttttgcagttgatgacttaaacatgcatcttttttggtgacatgaccttcagttccaataatagacacaaaatctgagttcatgaaaggaaatagtagaaatgaatgtatgtagtcaggactttttagcttaccttactatcactgtgagagagacagtgctttcaattcctgttactgtgagacaccctccagggatttcatttcacctaatttatacaaccactagactcagctcttggtttggttcagtcagccatccatcaaggagcttatgagatgttccttttctcattcttgcagcaactatttatttatttaaatttaaatgttatttaaatttaaggggtacaagtgcagtttttttatatgaatatattgagtagtggtacagtttgtgtttttagtgtatccatcacccaaacaatgtaaattgtacccatcaagtaatttttcatcatccaccccgttcaactcctccctcccttctgtgtctccaaggtctccagttccgtattctgtccatgtgtgcacatgatttagctcccccttataagcgagaacatgcagtatttgtctttctgtttctggtttgtttcactaaagataatggcctccagtgtatccgtgttgctacaaaaaaaaaaaaacatgatttcattctttttttaatggctgtcactgtctattgtgtatatatgtcacatttttaaaaatgtggacatttaggttgattctgtgactttgctattatacatagtgctgccataagcataccagtgcagatacctttttgatataatgatttatttttctttgggtagatacccagtagtaggattgctggatcaaatggtagttccactaattagagattaatcttgctgttgggtaatattgagcttctgaaagttccgtcacttattcaaagcagtgaataatccttaatactgaagttggtaacttctatgttgccactatcttcaaccatgcatacttctttctaggatggaaccaacctcaaaaagaaaagtccaaagtacagcttggatttggtttagataagttattaggtcactcagttgcacaggttcctaaaagtcattttcaggctttgtaggtaggtggaaaaaagagcttgataataattgaataatggaagtaacttttagcctatattttacaaaaaagacctaccatttatcttaacagtgctgaaacctagtatcacttaaaaatttttctaatacataaaatttgagaatttcatagcaggtaaactcttattttaaacatcttttgaggttgggcaataaattctagtgcagaaagcactgttctgagtaacttgtgaatgtagaagttcatcagattatagaaggcagtgatgctggctgaagcaagttacctcccccttttttatccttacttccacccctcttctcctttccctcttctttctccttgcaagttttaaatgcagcttatggaggtaaaattgacatctgataaacttcccacatgtaaagtgtacagtttgatatgtttgaacaaatgtatacacctgtagaattatcaccaaaatcaaggtaatgaatatgcccatcacttacgagtttccttacaccacgtaggtaatacctgccacctctctgctgtccccattctcagataaccactgacctgctttatgccattatagattaatttgtatttttctagattttatgtaaacggaatcttacagtatgtacttctctttttcagtttgtcgtctttcattcagtataattatcttgcatttatcagtcatttatttctttgtattgccaagtactatctgtaatgttccattatgcagatctatcagtttgttactcatttacctgttgatggccatttggattgttttcagtttttgtctgttactaataaagttgctttgagcatttatgtacaattgtttgtacataagcttttattttcctggggtaattacatgggggtggaatggctggatcatatggtaggtgtatgtttaactttttaaaaaatggacaaacttttttctaaggtagttgtaccattttatactttcaccagtagtttttgagagttcagcttcttccatgtctattccagcacttagtgtgatgtgttgtgttaatctttagccgttctagtaaatgtgtggtggaatctctgtatttttaatttgcatgtttctaatgactaacagtgttgaatgtcttttcatgtgcttatttaccaaccgtatatctttgatgaagttcctgttaaaatctgttgtacatttttatttaaattgggtttttttgttattcggttttgggaggtttttaaaaatgtgttttgaatacaagtttattatcagacctatgatttgcagatactgtctcctgtctgcgcttatctttatatatatctattcttcacagtgtttttggagagcaaaagtttttaatgttgatataggccaatttttaaatttgtgtattgtgcttttgatgttgtgtataagagctcttgtctaactcaagctcacttaagattatctcttatgtattctcctagcagttttatagttttaggtatcacatttatacttatccatttggagttagtttttatatatatcgagagttatatattgatgatttttttttgcatgtggatatcctttgcacctttatcagatatcagttgtccatacagatgtgtgtctatttctggagtatctgctctgttccattgatctgttgtttttctgtctttgcactgatctcacatggtcttggactactccagctttatagaaagtcttcagatttgagagtgttggtccttaaactttgttcttttaaaagttgtttcggctctttcatatcctttctattttcatgtggattttagaatccacttgtcgatttctaccaaaaaacccgaaaaaaaccaacaacaaaaaaacaacctgctgaaatttttattgggatttttctaatttgtaggtctactgggggagcattgatatcttaacagtattaagtctgttgacccttttttgtggcatctcactttattattttacatcttctttaatttttctcagcaatattttatagttttcgctgtataagtctttcatgcttttgctagagttgcccttaagtgtataatatttttaatgctaatacgtatttttaaatttaattttctcatgtgactaaatgcacaaatatcatttgatttttttatattgatcttgtgtgcagcaaccttgctaaactcaaattccagtagctttttttacctgccttcagatttactacatagatcatcattttgtctgtgaataaagagagttactcctttctttcccaattagttcctttatttatttttgtcttgccttattgcactggctggaaccttcagtatgctgttgagtagatacagtgagagtagacatccttgttttttttcctgatcctagagggaaagcattcatgtttccttcattaaatatgatattagctgtggacttttcatatatatatatttttaatcaggttaaggaagtttctttttactcctagtttgctgagagattttgtcaggaatggatgttagatttttgtcaaattctttttccagatccttgagatgtttttgagatgtatggtttgtttgttgttttaataatggtgagttatatgaattgatctcagatattaaacatagcttttatttctgggagaaatccagttggttaggatgttttatcttttttatctatcattggattcaatttgttaaattactaaaatttagctaatttgctaaaattcatttaaaatttttgtatctatgagagacattgatgtatagttttcttttcttatttttgtctgacttgcatcattgtaatgctagcctcataggatgagttgggaagtatttcttcttcctgaattttctggaagaatttatatagaattggtattattttttctgtaagtatttgatggaatttaccaatgaagccacttgaacttggcaatttctttgtgagaatatttttgactgaatatccagcttctttcaaagatatagttctattcaagttacgtatttcttgtcgagtgatctttggtatttgtttctttgaagaaatttatccctttcatctaaattatcaaatttattggaataaaattattcataatatttcttttttattattttaatattggtagagtctgtagtgtgttacttctgtcttccctgtctccccctccctcccacttgtttctgatactggtaatttatgtcttctttttttcttcccaattagtccagctagaggtttatcaatgttattgatgatctcgatgaaccagctagctctcagttaaatgattttcttttcttttcttatctttaaaaaaaaaaaaaaaaaaaagtcagggtcttgctctgtggcccaggctggagtgcagtggcatcatcctagctcaacccaaccttgaactcctgggctcaagggatcttcccacatcagtctcctgagtagctgggactacaggcatgcactaccaccaccctgctaattgaatttttttttttttttttggaggtggggtctcactttgttgaccaggctagtctcaaactcctggcctcaagccatcctcccaccttggccccctaaagcattggaattacaggtgtgagccatggcgtctggcctccgttacatgattttctgtattgcttttctattattattttttttgacggggagcggtgttcgttctgattgtggtttcttccttttacttatttttgcttaatttgctttttttgtttgtttcttaaggtggtccatgttccttttaaactgtgaaattttttaaacatagactaaattacagaggagaaacagctacccaaatcctatattggcatatttactctttatatgtcttcaaatattataaatagaattaaagccctcatcacatttccctttccagatctcatcactaccctgagtgtttcctttaacttgtttgtttaggtcatccatatgtgcattttcccctacattttacataatatcgctttatgtattttcacatttaagtaaatggaatcctatatgcgttctttattgtacattttattcaacatagttttattcaacatagttttcaagatttatgtaaatatagattcgtaatatacagatttagttaatttattttaactgtagtattctaatgattaaatacacctttttattttatttttttagaaataatcataatgtagattgcttctcatttttttataattataaacagcacaaaaatgaagaattgttttgcatgtctctttgacaacttaggttacagattatttagcatatgtccctggaaatacagttactaaatttaatgatacaaatgtctccaactggagtaccgacttaaatttccaccaaaatttctatatcaataattgtatttggtatcagccattcctgactgttagtagcttgcttactttatagtttcagttgttaaggttacctcatgatccacattggctcctagagttcagctatcatgtccacacgaaggaaaagaaaagggaagaactaaaaggattttcctggagtcacaaaccagtggttttgtgttgatacctctttggctgcctttctatactttaaagactgggaaatgtagattttagccacatacattgtacagaggaaagggggaatggttatttagtatgccatcagcatttactgtcacagatctccttttacctggtgtgtactaacatttgataataaacgtttaatttttggcagtttgaaatggtatctcacttttaaaattgcatttccttgattggtgagatacagaattttttacatgtatttaggctttttttaaaaaaaaattgcctttgatataattctactgagtttggtctttccctaattagtttagcataactctttattattcaggatactgatcttttgtttctttacatccaaatagatgtttttgtctcttatttttaaacttttggtatgttgtccttgtttatacacaagtgttcattattatggggttaaatttaacaggtcttatcctttgtgatttgttgtttttatgtgtgttcttgggaaaaatttttttcctatataaaagtcatggagaactcttagaaaaaaagttttaaacttttgctttttgcaaaatccatttgggagtttttgtatatatatttgtgaatgatttaatgtcagaatttaatgtttttctatatggaaggccagttgtcccagcagcattcattgaataatgcattcttttgctatgatctgctttgttaacttctgtcatatatcagatttctgtctgtgcatgaacttttgcatctgtttctttggtgtatttatcttttatttgtgattgcttcataaaaagtctttgtgtagtaggtcagtatctcttctttaaaattatcttagttattcttggctctactttaatataagctttagggtcagcttgttcaggtccttgaaaattttgattagaatttaactgaattcttagattaatttgggagaatttgacgtgcttctcatcttgaatcttcacatttgtaatcatggtctgctactccatttgttcaggttattgttatgtcctttagtaacattttatatttgttttcataaaggttctgcctattttattagatacatttcctggtgacttagtttatatttttattgagaatgatatctttttattttcgaattagttattggtatatgttattggttatatacggatctttaggaacccttccttatgttaccttagtagttgagttgttcatcattctccagctttttttcccccaataaacccacatttattcacttcttctgcatttcagacctgtggtcatcctgttttctgcttgagcatgacagtcatgctgctgtcactacctttttcaggcagctcagagcatttcattttttaaatgcagctcattgccattgtgttgtttgtatgaccaaaaggaactgtcagagagataagaaggttacattaggttatgttccttaaaaatcacaaagacctctctatctcattgctcttttctgtccccccttctcatcttcagttctcggtttacttgttacctttattctcccactcccatgtccatctttctcttttatttgcccacatttcccttccttctcccttccatttggtaactatagtttttagcacctgccaggcactttagtttgtgctttgcatatgttaactcatttgccctttatcacagtccactgaggatggtggggcagtctcatttcatagctgaggatgcgaggaggcccaagcttatataagtagaaagtaggagagcttggataatgtcaggcttttcagactcctaatgtcatttttttttccgctttgctatattattgaggttgtttctttctactgtttttataagtggatgaagtaaatgtgctgtatgtctctaataagattttttagtaaacctatttagatagtgtctctaaaataaagctgtgtctgttttgggtggagggtgttactcgatctttcatgatagccattctcatagatcactctaaagaaaaagagatttacagagagaagaaagatttaaatgcagaaataataagtaaaatttactacgtcaaatatgctttacaaaaacattatgtatagccatgtatctgtgaatgttctagaaagtggtccttttgtaagagtgcatggcaaacgttgatagaagaaacacattagggacagtggattctattcatgggtagtgtattgttctgggcaagtaattttacttttaacaggcattaatctcctatataatccaaggataggattgattatataattattatataatcgaaggataggagattaatgggtagaaaatctttgatgatacagctgtatttataaataagtaacaacatacagaactgtataattttttaaaaatcattttgatagtattttcatttttgtaaggtactttgtagttcttgttcatctgtgtatcctgtacttttacagttataatcatggtatctacttttattttttattttttcatgactcatgcatctctctcatgaactgtattcattttcaaaaaaattgattttagataatctctttaatgttgttgtattcccttttgtgagatagttcctcggtttctagttttgttttgttttttctttttgtaatttatggaacatttaagttacattcccagtcataggatgattctataaaatggtatcaacacatttatttctgttttattgtcaaattgctttcaaattggtttaaaacaatctataatgcaagaaatgtttgaatgattcagtttaattatagccagcatccagtcatttaacaagtatttattgagtctttgttctggcagaggttacattctagtagggaatatatgagacaaacataataaataagtaaattacactttatattagaggatgatgaaggctttacagaacagagcaggataagggagtgcctgatgggatgacttgcgctttgcatcagttaaagtaggcctcactgagaaggtggcatttgtacggggtcttgaggcatgggatttactttatgtatttttgtctttttcctttttttttttttttttttggctaatttaagaagtttatgtagtctcttaagattactgtcatctattttcattgttagtaagaatggttttctacacatttcctatttttttttctattttggcaaaatttgaaattttaatgaaagcacagaagttttctgtgtaagcctgtccctgtccatacaattaaagagtggggaaaattggctttaactacattgtttatgtttaaacctgagtagaatattctgttgaaggctttaacaagaaaacaaaaattattactagtttgacatttgaaataagcaagaataagattgctcctttctattgtatttccattttaagtaaaggcaaggtgatatttaagatgtataagaataacagatatttgttattttatagggtgactgttggatctgtatggaactcatgtctacctcgtttgataagttttacaaatatgtatatagtgtattagatgatgttattccagaagaaattttaggcaaaatcactttagcagtaagtacctggtctttaaattattcattgtgtatatagttatatagagatgctgctggagttttgaatgcacatatttgagtgtcactcacagtaccttcctgaaaataattcatagttaataaccagagacaaagtcacttctgtggggtagttaacacaataggtcataatggtctcgataaatactgccaatgttctttccctttgaatctcaatgagtcataacagactgttctgtaaataaagctaggaaaagcaattttctgttcattttttcctgttgctttaactatttttaaataggttatattaccacagttatcctgaaattaatcagaatcacagcagtctccttgaagccccataattgaagcccttggacaaagtttgtttactgtgatttaagattttggttactccataattgaagcccttggacaaagtatgtttactgtgatttaagattttggttattcagtctaaactatttaaaattttgactagcagtttcaggggccagtgttactactaaatttggttaactcacttttaccagagtaccaaaaaagaaaatagctacttttttacatatgtgtttatagttttgaaagtgaattgatcactttgtttcttgctctgaatcttaattttttttcctaaaggaaaaagataatttactttttatagagcaaaattcataagattcttagaaactcctgagaatctgagctaatggcatgttctaggttagttgatatataaactaaatcatacaggaaattgtaaaatagatactttggttgcatgtaatttcctagctcttccttacctgcatactccccctccaatgtagttcaccaagatatatactctttcaaataatttcataaaaagattttatgaaatcattttatttttaaattttataaaaataattgtataaaaagaagctaacttagactagaaacttattatttagcggggtatatgaaattttacaatgattagtttagccatctctctctaatatattaaacccgtgttatcttgaaacttactatttgtaataattataataatagaaaaatgataatagctaatggttattaaatgcttatttgcatcaaactatttgtgacattaaatcttcatagtaactctctgtggtaaatagtgttacctcatttttatgaatgataaatctgaagcatagacagattaaataattaatatgctttgaagtgtgtaagtggtaaataatctaaatccaggcagcctgatcccagaaccctgctcttaaccgctgtataacagggtgaccatgaaattagaaaacagaaaattattttatcatatattgcaatataaagaatatatactgtaaaaaatgatttattccatatttgcctaagtcaagacttggtgatcactttatatatattaagcacacatgtaaaatactttgtatttagtctcttcttgctaattaataaaccagcaaacaagcatagctattcacaacaaatttatgtgttctacatttcttgtacctagcagcttgacgtcagcaaagacgtcaccttacagcaaatagttggcctgttgtttagttctcttttagtttgaggttgtgtctcttttccttcccttcctgaagaaatgtgtaattttctgatcatgatcagtgaccaggcaacaggataaattcccacagtggtgaacagagtttacactagctcttcaaacatcaccttgaaggcttagcatccaatgagggtggatgatgatgaggaactgagagtttagaaaacttttttatttactactggacttagaaattgaaatcgattttgctgcaagttattactcttagttgaaatggaaccaactcagtgatcattgttgtcctgtttttatttttgaacattttagaggccaggcacaatggttcatgcctgtaatcccagcagtttgagaggccgaggcagaaggatcgcttgagcccaggaatttgagatcagcttgggcaacatagtgagaaccctgtccatactaaagatgtaaaaagttagccaggcatgcatctgtagtcccagctacttggcaggctgtggtgggagcgagacccagtctcaaaataaaaagggaaaaaaaaaaaggaaattttaggttggagataggaaaaaagataaaattttaaatgaattattaaacaaattataagtctaagttactgggttttttgtttgtttgagctatcagggaacagcatataaaggcaactaagcttttagatctaaaattattcagtatctttggttaacaagaaatgacaaaatattgaaatattaagcttaaaatgtatgcagaggactacacgggatattacttgtgataaactgttgtgctgtttgaataaaaagaaacaagttgtttatcccatctctcctttttctccctagactgtgaaagcactaaaccacttaaaagaaaacttgaaaattattcacagaggtgggtatggattggtattttttgtaatagaaattaacttttttctcctaattggtgaaacggttattgaaaattacagtgtcactgtataaactttcctaaaatatttgtatttttagcaaaaaatgctttatgtactttaaaactctattactgctatttttttctttgggattcaataaatttcagtctatcttagtatgttggacttagaaactgaaatagattttgctgcacattgttattagttgaaaaataattattcatttgcctgatagataatgtttttctgcatacaaataaggcatcgaggtggtcctgtggacattcaaagaagaatctgagggatagtaccctcaagcattttaaaggcatgctatccctgtctgttgtttcttcttcacattagaggatgtttctaaattgagagaaatcttttaattagtattataagttgaaatttctctaaagcatgttgtatttgtgtaaacagtgatcttgcctttattagatacatattcaaatgaagcatttgatgtagttgaaggccagacctagaaaagtagtaaccctgtgggaatcctgaatttaatctggcaaatagatgaagtgcttgctttacttattactgtgctagactcagggtaatgaggtgctggctttgaggaaacacaccgaatcactacccctcagcaaatttgtaacggaaaaacctgacagtaagtggcagtgtgtgatttagcctgacagtaaataggaaggaaagtaaagggtcaaaatgaagagaagtgaaaaatttctaattctgggagacaatttctagtggttaaagaaattagtaattgggccatttatttaagttcttttgtttgtggttgacactaggccactgaaattagtgaaccttgaacatcagtaaattttatttaattttgtttggcttaatgcttgttagaaataatatctttttttcttttggcctaaaattatgtagagttaggtccctaaacaaaattctttgtttctcttgtatttcttcttgttcttgtcttgatttttttttttttcccttctttgttagctgtgttctataattatgagagtagcacctttgaggcatttgatagttaccttagggatatttactgatcacagtaaagcaccaaggtactgcctggggagtagttgaataaaataaaaaaacttcagaagtaacttttattgttctcttactaaatgaagtgatgagtttatagccatcttttatcagttaggatcagttagcttttttgttggagtcagtgcttttgattacaagtaatagaaaatcctgataactctctttaaacttcagggaaattcattatctgtcataattagtccaaagatggggtggctcaaagcacaatatgctcctcttccttctgtcctccttcatgtgttaactctgtcctcagggtagtaacaactagagcagttcccactatcatgtctatatgtggctgcctcgtgaagaagaggtgctctcgtgctgtgcagctctgtagggagtatggaaacttttcccacgtctctaataccttttcttggctcattcaccagaagtgcctcatgcccttaaaccagctactatcaagaagcatgagactacccttataaaacttataccagccaacagccaggttttcgaggtgtggatgttgatgagaagagatacttcaataaaacacaggttctgttagaaagtatggatggggctgggtgtggtggctgacacctgtaatcccagcactttggagaccaaggcagctggatcacttgaggtcagaagttcgagaccagcctagccaacatggtgaaaccccatctctactaaaaatacaaaaattagccaggtgtggtggcgcatgcctgtaatcccagctacttgggaggctgaagcagaagaatcgattgaacttgggaggcggaggttgcagtgagtggggattgcaccactgcattccagcctgggtaaaaaagagcgagactcttgtctcaaaaaaaaaaaaaaaaaaaagcatggatggttaggaatggatgtttgataggcccacagctgtttcggtcatggtaagagatctttactgaatttttttgtggatcaccttctgagttacatttagatgttttctgcatcctatattttaaaaccttattttttattcattgagccaggatagtgacaaggacatggataaaaggactgagctatggatagagaattagttggcacatactggtagtgacttgattgtcaatgagaaagggatttgacattccttatattttgactgttatgtaatgaatctggactaagtaaatgaatttgtaagcctcttgaaaacaatttaatgcctaaatttcttgtgaaaattttttttgatattcagtttttaagcactggcattcagaaaattgttttcctttctcattttcaatagaagaaaaccattgttttttctgtgttttataaatatgaagatgttaagagaaaaatcaatccccatctatatcttacagattaatgtttgtgaaatgacttttgctgttacatttacacaattatagttattaaagctacatgtttaaaacatgaataattattgtatgtgataaatgaagatgttttacttcttatatatctgaatttaaggacttgaccacttatgttgtctaaggtttttcaatatttttgcttaaagtgaagccttatgtaacttaggaagaagctaattgtatactgaatgatatctatgtcttgcagatatcaaaccttccaatattcttctggacagaagtggaaatattaagctctgtgacttcggcatcagtggacagcttgtggactctattgccaagacaagagatgctggctgtaggccatacatggcagtaagtgttaagtccaggccttcttgcttgatagtcattgcacagagagcctgtgctcttttgtgctggccattagtcatacggttttaccatgaaactgctagaatatttcccttaccctaaggcccaagctcaggtcctagcctctccatgaaactttgctaaattatcccagtcagctcctgttttcattgtcttgctttatttctcttacttggtatttagcagttgtggtcttctctgattattgttttttcattatattgaactcaactcattaaacagatggtaacttctcagaaagttcccaccgtcccttagtgagacaaatgggaagccttgagttcattagcagaattcactatgtattacagagtctgaagctgcatattttgaatattgttagtccttttttttaggggtagatgaagcacaccaacaaatgcaaaggtagaggccttcagtattttgcaacctggagcctcttttcctgcaaagagacagatgtacactatccatccatagatatcaaactcatcttaccccagtatatttgcatacagtgttcctacagcctggattttgatctgtatttgaatgaaaatgtagtgtctgtatttcagacatttccctaggtgttaatgtctttcttcaatgttgccatggttctttggggaccagcacactactaaatgtgacacataaggttttgtggttgtttcttgaggcctccctgccagcagcatttctttccatctttgtagactgttttaaactaaagataagcttagaattgaataaaattgttctttcttggtttcctccttgatatatatgttttcaaacctagtgctataaataataaaaaagtaagagtcacaggctagatattataggtgttctagattatttatgaatggataggcttagtgctactacaaattcaacttactgcatttttcaatcctcttttggttttgttatatcttcccatatcactttttcttcagatgaacatgtaaaagcggtgtgtgtgtgtgtgtgtgtgtgtgtgtgtagacacctaacctgtgtggtaagaccttttaaacttttggttttgtggatgttgactggctgggcagatttcttgactcagtttggaagatcatttgtttatcgtgataactagggataaatggcacaatagtttcaaaggcaagaaataaaaaaaattagacatggagtatttgggaaatgtgatttacatatttattaaggataccccgagaatgaactgaaattgttatttacagttttagggcttgtctcgatactaacagtgactaaatgtttttgttgtgtgacactgactaagaattatatttgattgaagcaggctttgaaaatgcaattgcagcccagataaagtagaatattttgaattcagctttctaagaaagactcagactttctttaaaacagactttcgtcattcttgtgcagagatatgctttgcaggcccaggagatgtaagacttctgttttcttgctgaccttcatctgtggaacacaaaggctgataaactcttggcctctaatctttactggaccagatgaaattcttctgtccattctcatctttcaaagcctgttatagatagacaagaactcaatcaatgttaattttaaaaggcttcaagtggtttgacttttcttcaaatattgacaaaacctattggaggtatatcattttatttgagatttatagttgtctttagtctacaggacttaggattactcattagattgtgcaacataaaaaagtaaataaaatgtagagtttacacataaattttcctgtaaaccgatttcttgtaaacattttcccaactccataccctcatgtaggtacacagtcttatgttgcttaaccgtgggaatatgttctgagaagtgtgttgttaggcaattttgttgtgcaaaatcataagtgtacttacacaaacctagatggtatagcctactacacacataggctatatggtacagcctgttgcttctagactacaagcctatacagcatgttactgtactaaatactgtaggtaattatatcacaacagcaactatttgtgtgtctaaatatagaaaaggtacggtcaaaatatggtataaaggaggtagaggtgacgggccggagaaagatggaagactaccaggctgcggaggagactgcttttgttgttgatgaagtgagcaaattgtaaaagaggctatagaaagcacaattggtggttaacgcttattaacacagcaaagtgaaccagtggaacacaaatgtagtagaacaaacttcaagccaactcaccaagctgggaaaaccacttaaatacattgtgacctgtgtaattatgcaaaagaatggagctggattacacatggcaagttcctgcttctgggacagctctgctgacaggagctgcactgtgcgatgggagaataaaaccatgtactgcatcgtcggcacctttggactgtgtattggacctcctagtccagcctgtgaccttcctccggtagttcatcttctaacaccagctatgaattgagtgaactcttttctcgttctttttaagtctgttttgtggcactctaaaaatgcagagaaaaaaaccaaatgaccgcactgttacatgaactgtgcactgaagtcagatgagtatccctgtaggtcgcctgcagcctgcattgccacttgtaactctgaatatttcttttcaaaggtgctaaaatctgaaatctgctggtgtgaaacttgctatactgtctgaaatgattcaaatacactaattttccatactttatacttttgttagaataaattattcaaatctaaaaaaatatggtataaaaaataaagaatggttcactggtataaggcactaatcatgaatggagcttacaggactagaagttgttctggatgagtcagtgagtgagtggtaagtgaatttgcaggcctaggatgctactgtagactttataaacactgtacacttaggctacatgacatttataaaaatttttttcttcagtaataaattaacctgagtgtactgtaacttttttactttatacactttttaattaaaaaaaattttttttacttttttgtattaacacttagcttaaaacacaaacacactgtacagccgtacaaaaatattttctttctttgtatctttattccgtaaggctattctgtttacttgtttattctttttaaacttttttgttaaaaactaagacatcattctaggcctatacatgggcgcgatcaatcactgtcttctacatccacatcttgccccactggaaggtcctcaggggcagtaacacgcagggagctgtcatctcctatgatatcaatgccttctttgtaatacctcctgaaagacctgccagaagctgttgataacttttttttaaataagtagaaggacatcaagtatagtgtactgtacataattgtatgtgctatacttttaaatgactggcagtgcaataggtttgtttaaaacagcatcaccacgagcgcgagtaatgtgtcactctacgttatgagggctatggtgtcattaggagataggaatttttcagctccattataaccttatgggacaacctttgtatatgtggtctgtcgttcaccaaaatgttgttttgcagcacgagacaatttctgtatgtgggtatggatgtgccaaaccacctgaaagttagttgcagatatcatgcattttattctaaacacttcagtgcatatctcccaagaaaaagaccattcttctacataaccacgatatcattaccacacctaaaaaaaacaaacaagaatgtcatctttgagcatccccattccaaaaatgcaaagcccgaaatgctcccaaatatgaaacgttaccaacactagtgtgacccaagtggaaaattcacctgaccttatgcgatgggtcacattcaaaatgcaggtgcaccacatcttgttgattcagtgttcccaaggtaaaaaaaaaaagacccttgtggccccctttagctgcaatatatcttttccacacatgcccagattttccccacataagcatgcctacaaagggtaataaaatggcatgtatgcaggcaagatgtgctaatgacaggttccacactatacctcacatggggccaagacctacctgcattactcactgtatttttttttgttttttttgctcattttttgctcagtagcttaaagttaatgttgaaaatgtcaaagaggcctgcagatacccctagagagacagcagtttgttaaaggggataaaggggaagtgtttatgtttatagcacagaaagtcaagctgttagagaaactggacaatggtgtaaatgtgaaatgtcttacagaaaagtgtggtgttcgtatgagcaccatatatgacctgaagaaacagaaggagaaactgctgaagttctgtgctgaaagtgatgaacaaaagttactgaaaaatagaaaaacaccacataatagctaaaaatgaagatcttggtaatgtattaaaagagtggatctgtcagactcacagtgaacacatgccatttgatggtatgctcatcatgaaatgaacatctatcatgaagaactgaaaattgaagggaactgtgaagattcaacagactggttatagaaatttaagaaaaaacatagcattaactttttaaagatttatggtgataaagcatctgctgatcatgaagcagtggagaaattcattgatgaattcgccagggttattgatgatgaaaattcaacatcagaacaggtataatgctgatgaaacatcactgttttggcatgattaccccagaaagacactacagctgatgagacagcccctgcaagatttaaggatgccaagagcagaaaaactgtgacgggatgtattaatgcagtaggcccgtataggtataaatctataggaggcaaaagcttgcatccttcctgttttcaagaagtgaatgtcttaccagtccattattatactaatcaaaaggcctggatcactcgggataccttttctgattggtttcataaacattttgtaccagtgccttatgcttattgcagggaagctggactgaaagaagagtgaaagattttgttatccattgataactgttctgcttatgctgcaaccgaaattctcataaaaaataatgtttatgccatgtactttcacccaaatgcgacttcattaattcagccatgtgaccaggatatccttagatcagtgaagggtaaatataaaaacactgtcttgaacatcatgctagcagcagtgaacagaggtgtgggtgtggaaggttttcagaaggcgtttagcatgaaggatgtcatacatgctgttgccagcacttggccaacagtgactaagacacagtcatgcctgcttggcataacctctggcctgtgactattcagtgatgatgatgatgatgaacaaggtagtgacttggatggattccatatgttaaagtgagaaaaaaatgatatctgacctccttttatatgcaaaaaatacatctttagagtctgtcagtaaacggaaagaaggggatattaaagaagtttttattatcaaattaatgaagcttcagtttttcatttattgactaatgatgaaatagctgaaatggttctgaatcaaggtaaatgtgatatttagtgataatgaggatgatgttaacaacgaggaagaaatgcccatagacaaagtgcacattctgcatatcaaaagaaactatcaacagagtaaacagataatctgcagaatgggagaaaatatttacaaataactatgtgtctcacaaagttctaatattcagcatctataaggaacttaaatttataagaaagaaaacaacctcattaaaaagtgggtaaggacgtgaacagacacttttcaaaagaagacatgcatgcatccaacaagcatatgaaaaacacaatgtcactgattattggagaaatgcaaatcaaaaccacaatgagatacatctcacaccagtcagaatggctgttaaaaaatgtcaaaacaacagatgctggtgaggttatggagaaaagggaatacttatatactgttggtggaaatgtaaattaattcaaccattgtggaaagcagtgtggtgattcctcaaaaagctaaaaacagaattgtcattcaacccagcagttccattactggaaatgggtatataccaaaaggaatagaagtcattctgtcataaagacacatacacacatatgttcattgcagcactattcacaatagcaaagacatgtaatcaacctaaatgtccatcagtggaagactggataaagaaaatgtggtacatatacactgtggaatactctacagccataaaaaagaatgagagcatgtcctttgtgggaacatggatggagctgtaggccatccattaatatctaaggatacttacttagcaaactaatgcaggaacagaaaatcaaataccacatgttctcttaagtgggagctaaatgatgagaacacatggacacaaagagcaacaaaacagacactggggcctacttgagtgtgggaggtgggagaggatcagaaaaaataactattgggtactaggcttagtaactgggtgaccaaatggtctgtacaacagacctctgtggcatgagtttacctatataacaaacctgcatgtgtaatcctgggcctaaagtaaaagtttaaaaaaaataaaaattaggccgggcgcggtggcacatgcctgtaatcccagcactttgggaggccaaggtaggcggatcacttgaagccaggaattcaagaccagcctggccaacatgtgaaaccccatcactactaaaaatacaaaaattagccaggcacagtggcacatgcctgtaatcccagctagtcaggaggctgaggcatgagaattgcttgaacccaggaggcagaagttgcagtgagctgaggttgtgccactacacttcagcctgggcaacagagcaagattctgtctcaaaaaacatatatataaataaaaaggaaaaaaactaaaaaaagttttaaagaaaatggaaacaagctccctcattcccccccccataaaaaagaaaaaatgctcttgatgaaaatgtgtaatggactcattaaaggattagagcagtatgcattcataacacaagaagaaatcatgtcagtttataaaactgaagagagactcctaagacaaaaaccattgttaatgaggcagttgactagggaggaaacattttacaaagccatctagcagaatgcctcctcattactagaggacccacttctggcccctcaaatgcttctgatgtttcttctcacctaaaaaaataaaatacagtgtacaatagccttttaatcaaaacacagcatcgtagttggaggttgaaagcttgtagctgtttgttgtagctgctgtttaacagttgatgcaggtattctggcgatgctactgtgctgcttagttccccagaactcattgtttttcactgtattgatacgtcatattttttactgttaagtatttgtgtgaacaagtgtaagacaatgattgcctattaatagcatgtaaattccgagtccggaatgatggtgatgcccagcaaccacagattgtctacctgggtggctgagatagtgacacttttgctttttggtgcttcagtgtacacaaactttgtttcatgcacaaatttatttaaaatataatataaaattaccttcaggctatgtatatagttgtatatgaaacataaataaatttcacgtttagacttgggtcccatccccaagatatattattatgtatatgcaaatattccaaaatttgaaaaaatccaaaatcgaaacactcaggttccaagctttttggatgaggaatactcaatctgtattatctaatacatagttcatactcagatttcccatatgtcaaaaaaactatcttttagctgtcaatccagggtcacattaagattccataccagctactcaggaggctgaggcaggagaatggcgggaacccgggaggcggagcttgcagtgagccgagatcgcgccactgcactccagcctgggtgacagagcgagactccgtctcaaaaaaaaaaaaaaaaaaaagattccacattgattttaattgttacattattttaatatatacagggcttgatcattctttttgttttctgtgacattggcggttttggaagtgttttcagaaggtctcgcattcttataatatctgattgttccctcatgattagattcagactacaactatttttagacatgcatacttcatgtatgaggagtgttttttattgcataacattgcaaagcacataatggttactatttgtaatgtttacagacatgccttttttttaagcagttaaaacagttgcagaatagaaagtggtatgtttctttattcatttaggtcttcttgccatctctcagcaatgttttgtagttttcagtgtgcagcttttgaagaccttttaaatttatttctaaggagttcatggtttttcgatactgtgaaaggaaaataaaaacttgggaccccaatttactatgccaaaacaaaaaattcagctgaaagctgagtgatgtaaataaaaaactgcctttccttttgttcttaagcagatagctacagataaagttttaaatatctccacaggtagctattccgttcaccttatcttatttaagtgctaacttactgaggatgagaggaatacataatcaactattccgtacttgctccttttctcttgcaacatacggattcagtaatgtgaccacaccctccctcgtccccctgctgcctgcttttcctctttaattattgaagccctcaaaatcatatttggagaaaggcacaaacttccctttcaggcatgtccttaaccgtggcaagataaacttctaaattgattgagacctgtctcggatttctttttgtcttagaatactgttattgggagtggaattaaaaatattttccaatattttgctattattatatagaaatacaactgctttgcatgtgttaacattggatcttgtgaccttgctagtttagttttactgttagtttcagtaggaattttctgtgtctgtgaataaaggtaatgcttgttttcccccttgcctttctatactggctgggtcctccagtagaatcctgaatagtaataataatagtaggcatatttgccttatgcccaatattaattaaaaagaaagtgttctatatttcaccagtaagtataatgttaactcttggttattttagatgccctttatggaaatgaagatgttttcttctcttagtgtgttgttatttctgttgttattagtgggttttacattttgtcagatgctaattctacatttattgagatgatcacattattttcttcctttctataaataatggtgcattgcattgattttcaagtattaagttagtattgtattcttgagataaactctacttggtcatgatacattacctctttgtatgttgctggattaggtttgctcatattttgttatttttgtgtctttctgtgcaagggctattaattgtcttgtaatgactttgtcaggttttcaaaaatcgttatgctggcctcatgaaatgagttgggaagcgtaccatctctcacttttttgaaaaaaaaatttgtgtaaggccagtgttatttctcacgtatttgaaaagagttcaccagtgagcccatctgggtgtggacttttctttctgggcaggtttttaataacattcattaagtaacatagtttaaaggttattcacactttgatattctttttggtaggttttcattttcagaaaatatttctgtttcatctatttctgtaagaacagtagtaatggcccctctttcattctgattttagtaatttgtatcttttctttttctgtgggtcagtctagccaaaggtgtgtccattttattgatcttttcaaagtactgttggttttcttgacttttctctattgtttttctattcctgttttacttgtcttcacgttactttttcttacgttcttcctcctgcttgctttgtatttcatttgttcttttttttctaattctttaagctataaagtaggtttgatttgagatgtcttctcttctaatgtatgcattttacactatacattttcttctgagcactacttctatatcccacaaattttgggaagttgtaatttcattttcatttagttcaattttttaactatttcttgagacttttttgatccatttgtcatttagaggtgtgttgttaaatcttcagatatttgaggactttgcagatatcttcctgttactgatttctaatttatttattttgtgatctgagaacatgctttgcatgctttccatcttttaaaacaaggtgtgttttatgccccagaatgtggtcaggattaatcaatgttccatgctagtttggggaaaatgttgatcttgatgatgttggatggagtattttttctcttggttgaatatctgggattttaatgtgtaccttatcaggcaaatacttatatttacaacaaaaaaaaacaaagtaaatagcttacagtgaattttatgcagcacagtactcatgctcaaagcaatatacagatgtctttagttgatgctcacaggcagagaatgtaatacagtcaactattatgcttctctgggcatttctttcaacagcagttactctcagacttagcgaaggatccattgtcaactctgtgccaacaggaccctctctctctcttcccttttcctgacacatcatttagatggtccctaatttcaaggaaatgtaaagatgttctttcacagaaattactaaaaatgatttctgcggtacataggataatatattactgtcttggcagtgctttaatttggctacaaatgactaacagacaaatatctttacacatatgtgtagtgataaatttagcgttattgtgaagtatgggtggaataattgtgataaatttagctcttgttttgcttttgtgtctcaaatatattgtggtatggcctcatccaccgagcaaagtcttttaaaaatcgaagacagtcttttttgtttgtttgtcactcgttgccccaaatttgacctaattctttttttaaaacctttttattttttaattttttttttgagatggagcctcgctctgttgtccaggctggagtgcagtggcatgatctcggctcactgcaagctctgcctcccgggttcacgccattctcctgcctcagcctcctgagtagctgggactacaggcacctgccaccaggcccagctacttttttgtatttttagtagagatggggtttcaccgtgttagccaggatggtctcgatctgctgacctcctgatccacccgcttcggcctcccaaagtgctgggattacgggcgtgcgccactgcacctggcgaccttgtaattctttatgttttccagttttcttcctttgtctccctcttccctcagcttcagctttgtaaatgcttttgagtctttgaggggaatagttaaatgaattgcttagtgttctctttatggaagtagccattaagttttttgttgtttgtttttatgataatgatgacttcctattacttccattctgacgctagacatggattcctctaggaatatactggcattttggctgtctacccagctgttgcttccatttgcctattccttgagtgtaaggcaattaataacttacacttgtctttatgttccagcctgaaagaatagacccaagcgcatcacgacaaggatatgatgtccgctctgatgtctggagtttggggatcacattggtatgtttatgctgattcaaccttgccacagtagcgtaacaataagaaatttagaagtgaaagaaaacttaatcagacttccccgttcgttaagaactataatcacagacactatggttttaagttgctgaaaaaaaaaaagtatgtatttatttactttaaaaatcaaatcagacttgattatttcccttgaagttatgtgaagtgtctagagccctttaatgttttaactggatctcttggccacagataataggagtcaactattatctgcaactgcactaagaatgggaacaggacaagccagcttacctgcagtcaattcattgatgaaggcacataggcttctcccatctcaggcaaggtgtagtatgtccagtaatactgtatatagtgtgtatattaagtatacgtatttttatatgtggaaaatagtttctacttgcaatattctattcactgaatagtaaaatcacaagtgaatgagctgaaagtaattcagtttttgagggacaatatattagtccattctcacactactgtaaagaactacatgagactgggtaatttatgaagagaggtttaattgcctcacagctccacaggtcgtacaggagcaggggagagagagagtgaaggggaaggtgccagacacttttaaacaaccaggtctcatgagaactctatcatgagacagcactagggggatggtgcattagaaaccaccctcatgatccaatcacctcccaccaggccgctccttcaacacatagggattataattcgaaatgaaatttgggtggggacacagagccaaaccatatcagacaagaactacctaggtgataattctaaatgaaagttctaccttagaacaacactgagaaagaataataagaaagctacttaatttgcaacaagcaagcgcaattatataaactcttctttcttacctatggactgtattgaaattttggtttcatttaaaatatctgtattagttcaggctgctccaaccaaatgctgacctctgggctataatcttatcaagaacagaaatttctcacagtttcggaggctgggaagtccaagatcaaggcactgacagatttggtggctagtgagggcttgcttcctggttcataaacagccatcttcttgttgtagtctcacatggcagaagaggcaagagagctgtctggggtctttcttacaagggcactaattagattaatgagggttccaccctcgtgaccccatcacttcccaaagatccaccaccaaataccatcacattagggattaggcttcaacatatggatttgctggggggtggggacacacaaacattcagtctctagcagtatctttgctcatttcctttttaccaaattttgttttgaagtcttcggtttattttcttgtgcttgctgttctaccaggacttgctgggtttttctgatttgggatagcttctttagctgcttctacattgaaggcgaattttctatccctagatgaggctgtcctgtaggtaggcaggccaatcctcttctttcattttctcccattttcagtttttgctacctaagactctatagcccagaaatacacaggttcagagcaatgggctttttttgtagcttattaaataatcttcatttgttcattggtattacatgtttctaggatcttctctgtgatcagaagcacataaccttgttagttattcttgatgaatcatattgctaggcctagagaattcttcgtatagagagttgaaggccaacagctcacctctgcagaggactttgatttactttactttgtgaccaaatataggaaataccttctggaatcttttctcattgtgaagccaaccagctaaagaagagattcttctttagacaggagagaacatggatctcgggcatcttttaggtttggcaactggtcccaaagactgcagcaagacctagagcttccagctgaggcaactatttgcatacacaggatatttacaattcagaaatacttatctatgactaaacaattacgttttaaaagcaagtatgtacttctttacagaaagaaaattttgtgaaaggttttaacagaaaattttttagcaagtttcttttagtacttttagctaaaccttgttgtttaaaaggtattctgtacttacagttggttcataatttatttttcatagggacagtcttataaaaattgtgaaatgtatgaaattaatttctaagatcctaagtcctttattttatgacatacagccaacttttccttctattattaaaacacaagaaggaatctaatgaagttattcctaattctgtgaataaccaggaaggtttatgtcttgaaaagcatttataattttaacagaaagaaacttcagctaacggaatacatttttctgtgtgtgtatgcatgcatgcctgcttacttttgtgcacacatgtgtgtaattagaaacaacagtgagctgacagaggcatcctttagggaggaaacggaatcagtgttctgagagttctctctctcttcctgtatgccatcttcctctgtaatatgtttggagcctcatcctcatgtatcagtcacctgtcagtgcatgtaaaatgggattcattatgccatggtgcagatttaaatatgtttcttggaaaaagcaaaatttgtaggttttcttttcttttgttttttgagatggagtctctctctgtcccccaggctggagtgcagtggcgcaatctcggctcactgcaaactccgcctcctgggttcatgccattcccctgcctcagcctcctgaatagctgggactacaggcgcctgccaccacgcccggctaattttttgtatttttagtagagatggggtttcaccgtgttagacaggatggtgtccatctcctgacctcctgatccacccgcctcggcatcccaaagtggtgggattacaggcgtgagccactgtgcccggcctaattggtaggttttcattatttttcagaacagaaagggagatagatgagaatacgattcactggttattagagaatattttttttttggacccttgataggattgggacatacgtaagactcttcagatctcttctggtgtggcttagaggtactgtcctgagccctttattggggcttcaggatgcagggtttgaccctgacttgatttcttcactacttgtaaaatctggttgtggttgaaattgtagtatctgcagaatagctgtagagcaggatttgcacattgtttcctccaagctcagattaggcttttgtttgttggatgttcttttgccttaaaaaggagtctaaccacgattatggaccaaggccttcctctaagatggctacaaattgtgcgtattctatagtaaaatagttctaaaaccagtcttccagactttcttataaagaagtcagaaccacaggctgccctggagcatgcattgtagggacattgtctaggcttaagttttgtgttcccatgtattccaagtccttgaatttggttgattcagaattctctatattattttgatttctaaatataacttctacttagcctttatgattctgaagattcctccccaagctaacctgtgtttaattcaaggctttactagagttttgcttgtagtttagatttttttgtggcccttccagtggggagtagtaaatgatgcctggtgtattttgctctttcctctttgttctctttagtatgagttggccacaggccgatttccttatccaaagtggaatagtgtatttgatcaactaacacaagtcgtgaaaggagatcctccgcagctgagtaattctgaggaaagggaattctccccgagtttcatcaactttgtcaacttgtggtgagtacctgatttatgaatggtcgaacacgcatggcgagaatagtgagatttacttggtcttagcagcattggtactttacatggaggaaggggacccttggtcacatcaccctacttttcaagctgggactctggatcactgtggctgtatggaaggttacagctagctgggagaggcatcaccttcttattctgctactcaggtattggtgaaaaacagccatgagtggtggagaggctgctgtctccagacttccagtacctggtacaagaaataccaggttaaacttctaggtgagactgatcatcttactctaatgtggttctcacaatgcaattgcaccaaaatcacctggaagcatttactgaatcaagagcttgccagatcagactttcagggttggatctctgttctgacataacatagaaaacagttggttatatgtagtagggtcacatccacacgcaaagtgtagttggtagaactgtatatctttgctctctgaaaccttactccaaggaagatgtgaaccccacacctgttgttgtttgtctacctttttaatagtttgttgtgtgtttgtgtatatgtagcacctaagaataaacatatgcagatatggcagtaatataatcatgctttatactgttttaggctcttttaaataaaatctttttgtgttatcatttggatatttttgacatttattttgtttatccaacatgatttaaatataagacatgctatgaacaaaaagcctcagagcattttgtgtatcttctgtttattcctgaaaataccttttggtttctcataattttttcctgctaagaatgcggtttctcctcattttaggtcttatagacttaaatcagggtctaacattgccctcctttgtatgaaaaatttaaaaatatttgtttgactatagtttttaagtctctttcatcttctgtaaccaaattctacttttgtgttggtttttcagaggggagaggaatacttcaagattttctaggtagaagaaggacataaggatgactcaaattggctgcttcctccttttaaaaaacaatcaattctgtactaatttgcacacagtatggatagtttatataattgcataaatgtgatcattttatgtatttcatttttatgacatatttgcttaaaatgatctgtgtaagtcatagggtataatatctaaaatgatcacctgtgaaccttccatcagggtttctttttaactccttgatctctttattggttttgttctgtatgtgttggtacttgtacatgtttatttctgtttcccttgatgccataatagagtgacagttttagacattggagtcccattgttttccctgagtaggttcatagttccatgtcattgcaaatcattaaggtctacattgaagtgtacttatgttcataatatgctcatattagctctccacatttgtccattctttctgccactctttgtcttggacattgcctgtaatctctaacctggatcattcagatttctcataatccaatattgattttcttataatccaatattgtcttgttccaaattattcccctttttattagagttgtattttttatgatgtatatctgatcatgttacttctctatctaaagtatgcattcttagcagggtgatattgaccctaaggaggcaaaaattgattttggagaaatgaaaatcttaggttgtataatggtttttagtcctccaaagggccatagaatataaacagatatgcactatatctatcatatttaaatttcatgatggggaggataaataatgaaaaaaatactgagagatactattctatagagacttcctcttgtccttaaaattaattaatttaggctttcagaacccattacgatctggacttagtttattgctctggtcacatttctttttttttttttttttctttcttgtttttttggagatggagtctcagttgcccaggctggagtgtaatgatgtggtcgcagctcactgcaacctccacctcccgggttcaaacgattcttctgcctcagcctcctgagtactgctgggattacaggcacctgccaccacacccagctaattttttttttttaagtagagacagttttcaccatgttggccaggctgatctcgaacttctgacctcgtgatctgcccgcctcgacctcccagagcgctgggattacaggcatgagccactgcccccggcccgctctagccacatttctcatgacttccctctccttgaatggtttctgccaaactgaatttcttcagttacataaattaaaagcacatacaggataatatgggagaatgttttcattacgtttgggtaaagatttctgaaacagaacgtagaaagtagccaaacctaagagaaagattgattaaaaaaaaatggatttcattaaaattaagaacttccattgattaaaagacagcactgaatgacatgccaagccacacagtagaaggagatatttttcatacttatattcgacgaaggacttttacacagaatatgtaaagaatacttaaaaatgtaaaacacttatgaaaaataacaaccaaaaatagcaaaatacttgaaaggcactttaaagatgatattcaagaggccagtaaacatattcaatttactgcattcattctgcattattagtaatcaggagacatgcaggtcagaactacagtgaaataccactataattaccagaatgaccacagtttaaaatactgacagtaccaaatattggtgaggatctgaagcaactggaagtctcatacataacttgtaggagtataaattagtacagttcctttgaaaaacaagcagtatccagtatagctgatctaatatggttgatgtatacaccatggttcagcaattcaagttctgactatatacccaacaaaagtgtggacataaatacactaaaagacatatgtaagaatgtccggaaaagcacatttataacctacaattagaaactctctccacagtagaacagataataaattgtagcattatgtatacagcagtatatagcatcagagaagatagaaccattgcttcactcagcaacttcagtaaatctcacgaatgatgttgagtgaaagaagacagaaagcagtatgtatggttctatttctatatgaaagttaaaagcaaacaatataaggtattggaagtcagaatattgttactttttagttctgcacttaggagttgtgttttctgtatgtctgcttcgattaaaagttttcctaaggaaaaaaaaaaaaggataagacttaatggttcaaaaggaagaccttgccgactgaggtgtctgagcgctcagcattgggaaatggtcgactcgtgggttgataaaaagaatttacagacaacagtataggtttgaaaaaggaaagtttattagaaagaaagtatgctgcagaagagtgcagaagggtgctgagcgtgccacagtggatttttccttaggggtatttatggaccttaaagcttgaggataatttggaccatattagccatgtaggtaacaataaatgattacatttgtagtaattttggttccttaatgtcagcaagtgttgcacagtgaatttcgacatggcattctggagatgtatagaaattctagttacttacaaagtttttttggggaaaaaatctggaaccaatgcctgctttagataatagggaagtctgattacttcttgggttttgttgttgttgttgttgttgttgtttttaatatggagccttgctctgtcgcccaggctggagtgtagtggcgcgatctcagctcactgcaacctctgcctcacaggttcaagcgattctcctgcctcagcctcctaagtagctgggactacaggctcatgccaccatgcctggctaatttatgtatgtttaatagagatggggtttcaccacactggccaggctggtcttgaactgctgacctcaagtaatccgcccgcttcagcctcccagagtgctgggattacaggcgtgagccactgcgccaggctgggaagtttaattacttctgattttccccagataaggaattttgcttctagattgcctgttggatagtcatcgggtggtttttgctccttctgcattcctcagataaggaatttttgtctctagggcctgttcagtggtcaccaagtgattttgctctcctcagatctcagcccatattttaaactgtttcccaatttaactatctattgaaatcaccattggaattttttttaggggaaaaattctttatttgtcctgggggaagaaaaaacaaaaaatgttattcttgaggaatttttgtgaaactctggatggggataagactgaattcagggatggattgcctaatccaaaatttatcgtgtgcagaggggaatataaaaagtcactaggacgatataagacccatatacaactctgtagcttgggcagcagacctggaagaagaggcaacttgtgggactgcctaattgtgcaactaattaggcagtaaagctcgatcctgaaatgtcttgaggaaatgccttctgtgctagatctcacaggcagctgggacagtgtagtagtatctactcctgcctttctcttagcagcaagacctgtaaagaaaagctcaagctttgctgaaataacttctaacaacaacgcctgtgttggttagagggcgggagcacagtgcatgctgttagagcaaatgcaaaaattaaatccctatagtaggtgatgatgctgcagtgatggctctccacctaggtgatgatactgcaatgatggctctccacctaggtgatgatactgcaatgatggctctccacctgtttctcacagttaacctgaatccatagctgagattaactgtgataaagaaaaatcactaacagatgaaaactttcagtgattcggagaattgtacctaagaaatctaaacaaatatttcctttaaaatgtcacagaaaaaaaaacaaggtaaaaaattgtaaggagggaataatttgaattccagaaacgttatcttcagatagtaaacatgattcctgaactgaatgggggaaaatggtggcacacagcagattgagtattgcaggttaaccagatctgtaagtaacaccgtttagttaatctttaagaataaagggctaaaaagatgaacatgaggtaaatggtaagagagaagaaaaatccaaaatattctatttagctgattgtagacaaagaattaaaattaaaattccttctacttgaagaataactcaagttcttagattaaaataccagaccaaattaaacaagagagtagagggaagccacatctagatgtgttctgagaaaagataagacttgacaagttttcaattaaaacacatgcacacaaatgtacacaaaacaccaagtcagcaatacctgaagagcagagaaacagctataacaggaggaatgtggttacttcacattactttggtgcattagatatcttggacaacacttgcactgaaactactaaaatgctggataagctttttattttatttattttgagatagggtctcactcactctgtcacccagactggagtgcagtggcatgattgcagcttactgcaacctcaacttcccaggctcaagcgatcctcccatctcagccccccgagtagctgggactacaggaatgtgccactacacctggctaatttttgtttttttgttgttttttgcttttttgttttgagacggacttttgctcttgttgcccaggctggagtgcaatggcatgatctcggctcaccgcagcctcaacctcccggtttcaagtgattctcctgcctcagcctccagagtagctggattacaggcatgcaccaccacacctggctaattttgtatttttagtagagttggggtttctccatgttggtcaggttggtcagctcttgacctcaggtgatccgcctgcctcggcctcccaaagtgttgggattacaggcgcgagccactgcgcctggcccacctggctaatttcttaaaaaaatttttgtagagactggatttcactgtattaccctggttggtcttaaactcctaggcttaagcgatcctcctgcctcggcttcccggagtattgggattacagtggcgtgagccactgtacctggcctggataagcattttaaagtgccatttatttatttaggacagagtctggctctgtcgcacaggctggagtgcagtggcatgatcttggctcactgcagcctccacctcccaggttcaagtgattctcctgtctcagcctcctgagtagctgggactacaggcacgcaccaccactcccagctaatttttgtatttttagtacagacagggttttgccacgttggccaggctagtctcgaactcctgacctcaggtgatccgcctgcctcagcctcccaaagttctggcattacaggggtgaaccatcgtgccccacctaaagtccctcttaaaatgtaaaagagttggtgcaaaactgaggaatccatggagctctgaagttgactgaaattcagggagggagattatgggagagaaggaagagtcaaagtaaattaaaggataacccaagcaaatgtagatttgccatctaaattcatattgaatatggtaaaaatacttagagaatttaattttaagaaaaattacttttcagagtccctggttggaaagatatgctcctcttgcccccagttgatgggcagaagcaaaagcaaatcattcagcctaggactaaatgattccaaaaaataaagtcaagtggaatatgtagtccacaaaaaaatctcaacactcacaaaagaaatgagaatcagaaacaatggatagtaggaatagatctgcaaaggcttcaaatattggaatgaaaggaaacaaaaaataagtttaaagaaaaagaggcagcttagaaatataagcagggaacacatttataaagaaccaaatagaacttctagaaataaaaagcataaattaaaacaatagctgcattcaacagattagatatcattgaagagagattaatgaactagaagacagagctgaagctctcccaataaaactttttgagatgctggaaatgtcctataatctgctctgtctagtgtggtagctgctggcatttgaaatgtggctaatgtaactaaggaaatgcattttttattggaattaagtttgctaacggctaccttattagatagtctaaggggagctaatataattattgataacattattagtgtcagctgtaattcagaaaaagaagacagtcaatgttaatagtttaagatttcaacccaaatagcatcataagtttatacactgacataattttctgctccagtagatgaaatagaaaaacacaaaaccagaaaggtatggcagctttacaaagaaagcaaacctctgtgtgggtgaaaaaatgcaacaaaaatactgacagaatgctgtgtagatctgatgccatggacttgctgtattccaggtcatttttcattctggagaatgaaaaaaatgatatcagttacttcctgggccacagctttaagcaagctatggtactacacaatgacaaggctttagatactggttttgcaaccagaggactggaactgtaattgtcctaataccaacataggagtggaacttgaaaggtccattacaggaccctgtttgatactggtggccctgtgaaatagaggcaactgtaaaactgctctatgtgtgtatccctggctcccagttcagttcatagtgattagtggggcactcagacatatgttgaacaaatgaatggatatgcatggagggtaaacatgttatttcaaaatgagtctgcaaatcataattcttgaatactgaagtgtaatgctaagaaagcatttaacaaaatggaacagaaacttactttaagttgaaatagatttatgaaattgtctgaaatatgctgtaaaagaaaatcagtatatttaggatgctcaaggaaataaaggtataaattcaattaaaactgaggaagaaataaagtggttggaaatagaagtcttggaaatggaaaaatcatagctgttgatataaaagacacaacagacttgatgttctctagactggaaataattgaagacaaaattagggaaataggagctgagacgttcccccagcatggcacagattatatgaaaagcagtgaagaatcagaacagattgcagagttagaggttctaagatgcatgtaatggaaataaagaaggcaactctgaaagtggagaagcaatgtttacagagatcataggggaaagaaaacatttgagaactgatttagtataggttttcagattgaaagtgaagtctctttatcatgtaggataaacaaaggtataagcttaaaggtaaatttaaatataaatttaaaagtaaattttaattgatattctgtagttttgcttcagtgcataaatgataaacaaaggtataaatttaccttttaaatttatatttaaatttacctttaaatttatacctttgtttatcatcatttatgtattgaagcaaaattaccgagcaatatcaggaagagaaaacagattatctgttaaggattgataataagactaacagcagatttgttcccagccacaatagttgcaggaaaaagtggagtcacagcaccagagtgctgagggaaaataattgtcagcctggtcctaaagttttagactcagacactcaaatattcacagtaaggaagaaatacagttttaggaatgggaagactgagcacttacaatttatagactgctttgatccttgaatggtgtggaggttagggatgctgaccccctgtacagtcaaaaatccgcatataacttttgattaccccaaaacttgactactaacaaatagcctactgtcaaccagaagccttactgataacatagttaacatatattttgtatatgtattatatactgtattattacaatgaagtaagctagagaaaagaaaatgttattaagaaaatcataaggaagagaaaatatattatttatgaagtggaagtggatcatcataaagatcttcatccttgtcttcacattgaatagactgaggaagaggaggagttggtcttgctatctcgggtggcagaggcagaagaaaaatccatgtataagtggatttgtacagttgaaatctgtgttgctcaagggccatctgtacttgaccaagaagagaagttaacccagaagaaggatgtcacaggttggatgcctggaaagcaggcttttgagacagagataagagtgtaggaagttgactaggtagtgatcttgggatcaacactaccaatgagaaggaaacgagattgggcagaagaagttcagttgcagtgccatgtcattgaaggcctcagccaactctgtgttgacctgccttggaatgagggtcttggatttttattcacttttgtggatcagtcattagagatggactgtcccaggagggctaaggtggctgtctttagctgtggtaatcctgaagaggccgatagtaaagggttgtctgctggcggcttgccccacagtggaagaataagtccttccttcttaaagagggaatctacatagcacattgcagtatctgttacagaaggtgtgggatatggaaaacagcaatgagtttagaaagaggtgaactatgttacccatattaattcatgtttgatagtaaaatattaattgaggttggaagggaatggtgattaagatatgggccaagatagatgaggtaaatataaacaaaatgaaaatacttttggcagctttaattaggcaaggtagaattcaaggagaaaatgtcaacagagcagacatttttatatactgatgtagtcttcagtgaagttatattgttttaaacttttggaccaaagaacatattgagatacagagtataaacttttttaaaacttaaggataaattgataaaaatgtatatgtaatttatctcccagaattacttgattgctggtttctcttgggtagtatctgcataaatatctgtctacttatttatttacatttagaaaagcatatatgtacacaaataattttatacttataaaacatttatatatttaactgtagtattctgtgtagctatgccataatttagtcaattttcaagaattaatattttttctaatttttaactaatcatcctacactgactatcctagagataaatcttcagattatagactcacaattttttgtatgtgcttttactgtgtttagcaggctgtctgcgttgttactttggatctgaaggaaagaactatttcattatttgtaatatttcatctgtgaaaagaaaaatacttaggcaaatgaatctacattttaataatgttatttttatgttattttagccttacgaaggatgaatccaaaaggccaaagtataaagagcttctggtgagtgtgggactgtggggattgtaggtacatcctaaccccggaactctcttaacatgctggttcactaagcaagcagtgggcctctctgtcataaacaaacatctcaaatttattgagtgttttttgttaatgtttttacacaaagatttggaaagagaaaatttgcagttataatttttctactaatactagctaaattctcatggaaaattttggtcttaacatgttataaaaattacccccaaagaattctgactttaagaagccattttccactgcatagtctatttatatgggatgcagccataagaaaaaaattagtgaaaatttgtgtttattctgcctttataaaattcatgcaaatttacgtcatatagcctattcccatttctttgaaagttctcattcatcccatggaacttgggtgttttaagcagtctactgggtatggcattggtggggcagggagaaagtgttgtgatctaataatgtgggaatattttaagaaaagatccatttgtttgtcacatttaactactagctcttcaaggatgttgtgacaaacttatatcacagtccaccaatgactgtaaaaatatctagtcaacatacttagtctgtaaaagaaaactgttgctagagatggagttttaaaaggtgggttagtgaagcagatactgggaccctggctctggagagtacagggaagaagctcctggggcaaatttctcttgggcctcttttggtcaaaagaattacagcctttttgttaaaaggtcaaaagaagaggtcaaaaggattgcgacctttttgtaaaaaggtcctcctgttgtatataggagaaatggaggttgagatttatattggtgtcccaagaggaatagtgactggcatttgcgtcattcttcttagctcttagatggtgtggtggaggctccagctatgttttgtgctgagtgacaacttggctgtcttcctcaacaaacactccctggtatacagatgagtttccagacctcactgccaaggtggcaccttcagatcattaccacgtatcctctctctaggcatgcccatgcccattagcatatctgcatggaataaaggctgtactcgcctctctgaacttgtagtgttgcggtatttcatagctatgtgtggttgggagcctggagttctatgttctatagaaattggaaaatgttcagtttgggctgtcatacaaacttttgacttttttgttttcaattttcttgcagaaacatccctttattttgatgtatgaagaacgtgccgttgaggtcgcatgctatgtttgtaaaatcctggatcaaatgccagctactcccagctctcccatgtatgtcgattgatatcgctgctacatcagactctagaaaaaagggctgagaggaagcaagacgtaaagaattttcatcccgtatcacagtgtttttattgctcgcccagacaccatgtgcaataagattggtgttcgtttccatcatgtctgtatactcctgtcacctagaacgtgcatccttgtaatacctgattgatcacacagtgttagtgctggtcagagagacctcatcctgctcttttgtgatgaacatattcatgaaatgtggaagtcagtacgatcaagttgttgactgtgattagatcacatcttaaattcatttctagactcaaaacctggagatgcagctactggaatggtgttttgtcagacttccaaatcctggaaggacacagtgatgaatgtactatgtctgaacatagaaactcgggcttgagtgagaagagcttgcacagccaacgagacacattgccttctggagctgggagacaaaggaggaatttactttcttcaccaagtgcaatagattactgatgtgatattctgttgctttacagttacagttgatgtttggggatcgatgtgctcagccaaatttcctgtttgaaatatcatgttaaattagaatgaatttatctttaccaaaaaccatgttgcgttcaaagaggtgaacattaaaatatagagacaggacagaatgtgttcttttctcctttaccagtcctatttttcaatgggaagactcaggagtctgccacttgtcaaagaaggtgctgatcctaagaatttttcattctcagaattcggtgtgctgccaacttgatgttccacctgccacaaaccaccaggactgaaagaagaaaacagtacagaaggcaaagtttacagatgtttttaattctagtattttatctggaacaacttgtagcagctatatatttccccttggtcccaagcctgatactttagccatcataactcactaacagggagaagtagctagtagcaatgtgccttgattgattagataaagatttctagtaggcagcaaaagaccaaatctcagttgtttgcttcttgccatcactggtccaggtcttcagtttccgaatctctttcccttcccctgtggtctattgtcgctatgtgacttgcgcttaatccaatattttgccttttttctatatcaaaaaacctttacagttagcagggatgttccttaccaaggatttttagccccaaatctctcatattcgctagtgtttaaaaggctaagaatagtggggcccagccgatgtggtaggtgataaagaggcatcttttctagagacacattggaccagatgaggatccgaaacggcagcctttacgttcatcacctgctagaacctctcgtagtccatcaccatttcttggcattggaattctactggaaaaaaatacaaaaagcaaaacaaaaccctcagcactgttacaagaggccatttaagtatcttgtgcttcttcacttacccattagccaggttctcattaggttttgcttgggcctccctggcactgaaccttaggctttgtatgacagtgaagcagcactgtgagtggttcaagcacactggaatataaaacagtcatggcctgagatgcaggtgatgccattacagaaccaaatcgtggcacgtattgctgtgtctcctctcagagtgacagtcataaatactgtcaaacaataaagggagaatggtgctgtttaaagtcacatccctgtaaattgcagaattcaaaagtgattatctctttgatctacttgcctcatttccctatcttctcccccacggtatcctaaactttagacttcccactgttctgaaaggagacattgctctatgtctgccttcgaccacagcaagccatcatcctccattgctcccggggactcaagaggaatctgtttctctgctgtcaacttcccatctggctcagcatagggtcactttgccattatgcaaatggagataaaagcaattctgactgtccaggagctaatctgaccgttctattgtgtggatgaccacataagaaggcaattttagtgtattaatcatagattattataaactataaacttaagggcaaggagtttattacaatgtatctttattaaaacaaaagggtgtatagtgttcacaaactgtgaaaatagtgtaagaactgtacattgtgagctctggttatttttctcttgtaccatagaaaaatgtataaaaattatcaaaaagctaatgtgcagggatattgccttatttgtctgtaaaaaatggagctcagtaacataactgcttcttggagctttggaatattttatcctgtattcttgtttgaattcctcctctatttaagatatatacatggaatcgaagtgtttatgtaatagttctatccttttgcctgcaggtcagttgtaataaatctaggatgtgatgatga

SEQ ID NO: 32 - DNA, 22637 bp, Homo sapiens
gcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccggggctggaagccctgcccgagggggactgtgcctccctcccgaattgcatccggaagaccttacttttccaactgacttcttcaggcacggggctgccgctgggcatcccggacgcctctgcatctgtgcgcggagaagctcctacctagggcagcactggccggcctgagcctctcccagctggtgggggtggccgggggtgtccctgccttatcgcagccagacacgctgcacctgccgccgcctggcgggccctgcccaggccctgctcctttcccagccttcttaactttcaaaactttgcctcctgtttccaagaaaggaccttatctgctgggctaggcctcgagggactggcaaggacaccctgcgcagggcaccatgaccttggaaggaggtccggggaggggctgctgcggtgtctgctctcaccttcctcctgctcaggggccctggggctcctgccgtgtctgctctcacctctctcctgctcaggggccctggggctcacgtacatttttttttttttttttttgagacggagtctcgctctgttccccaggctggagtgcagtggcgcgaactgggctcactgcaagctccgcctcccgggttcatgccattctcctgcctcagcctcccgagtagctgggactacaggcacccgccaccacgcccggccaattttttgtatttttcagtagagacggggtttcaccgtgttagccaggatggtctcaatctcctgacctcgtgatccgcccgcctcggcctcccaaagtgctggtactacaggcgtgagtcaacgcgtgcggcctttttttttttttttttttttttttttgagacggagtttcactcttgttgctcaggctggagtgcagtggagtggtcttggctcactgcaatctccgccccctgggttcaagtgattctcgtgcctcagcctcccgagtagctgggattacaggtgcctgccacagtgcccagctaattttttttttttttttttagtagagacggggtttcaccatcttggccaggttggtcttgaacttctgacctcgtgatccacctgcctcagcctcccaaagtgctgggattaaaggcgtgagccaccgcgcccggccagcacgcttcttaatcagcatgcaggctgtgacatgcggaaaccaggggcacaggctctgaagtttgtactctggagctggagcagtcagggttaaatgggagcggctgggaagggtgtgtttccacgaggcctttctgatgtctcagtgcccagtctggacccgggtagaaggtgtggccagtgccttgagtcagtggagcagttgcctgtgcctggtctctgtgagatgggttggtcaggggctaggcagagcctgtgcctggtctctgtgagatgggttggtcaggggctaggcagagcctgtgctgggggtagcaggtgccctctaaaggggccagtgacagtctctctcccagcagtgagaaacccacgcttaggggccgggcgcggtggctcacgcctgtaatcccagcactttgggaggctgaggtgggtggatcgcctgaggtcaggagttcgagaccagcctggccaacatggtgaaaccccatctctactaaaaatacaaaagttagccgagtgtggtggcgtgtgcctgtaatcccagctactcgggaggctgaggcagaacattgctggagcctgggaggcggagcttgcggtgacccgagatcgcaccattgcgctccagcctgggcgacacagcgagactctgtctcaaaaataaataaataaataaataaataaataaataaataaataaatctggcttgagttttgacaaatgtatatgcagggtcaatgggaagacagacgctggagggtggaagcctgactgtgagagtgagccccctgctttcctgaacagtcagtggaggaggtcctgggagctcaggtgagcacctgaacggtagggcagagcctgagggtcttggtggagacaggcaagaaggttgcaggaacctagtctggcccagtgcctgggagaacgggagggaacacggaggcagggaggcagaggggttggcaggacctggactggactgtgcgtcgcagctacccacagcttgaccccactgccttgaagtgagtgatgcaccctcactagtgttcagcgtccaatttcatcctggccctgagtgtgtaacggctttgcccttgcggggccccctgggatgaggggtgagccctgtcccttcctggtcactgtctgccatcaggagctgccccgcttacagctgtgattcaggagccactgcatttcctccagccccctgggtgctgccagggggtcctcctattctgggagctggtgtgttctgactggaggctgccatgtgcagagtgctgtcaaggagaaggggtgtccactgcccagccctgaggcccaaggccttggccagccttgctgccagcgctgcagggaaaaagcctcctttgtgtgtgggaagtttaataaactccgctcagattgtgtctcgcagcgagtgtctggaaccttccagacaagcctcaggcgtccggtcctccagttggtgtggaaagcgtgggcgatcaccaaggggggtgggttggggcagatggagccggcgtgagtcccgtctcttcccttccttcccagaaaggcagccctggagtccatgccttgtcccgctctcaccggcaaaaagtataatcttattagaaataggaaagttccaaaaagcatcaatgagttaaaaagagggctgggcatgttcggtcatgcctgtaatcccagcactttgggaggccaaggcgggtggatcacccgaggttgggagttagcctgaccaacatggtgaaaccctgtctctactaaaaatacaaaattagctgagtgtggtggcgcacgcctgtaatcccagctactctggaggctgaggcaggagaatcacttgaacccgggaagcagaggttgcggtgagccaagaccatgccattgcactccagcctgggtaacaagagtgaaactccgtctcgaaaaaaaaaagggctggggccgggcgtggtggctcacgcctgtaatcccagcactttgggaggccgaggcggtttgatcacaaggtcagaagtttgagaccagcgtggccaacatggtgaaaccctctctctactaaaaatagaaaaactagccaggtgtggtggcacatgccaataatcccagctacttcatctgaggtcaggagttcaagaccagcctggccaatatggcgaaactccgtctctactacaaatacaaaaattagccaggcgtggtggcgcgcgcctgtagtccagctactggggaagctgaagcaaggagaatcgcttgaacctgggaggcggaggttgcggtgagccgagatcgcatcattgcattccaggctgggcaagcctaggagagaagagcgaaattgtgtctcaaaaaaacaattaattaaaataaaatcagtgccataggctgtttctggtaggcagtgggttcctagggtggagcagggaagggctggaaagggtcgcctgtgcccagcccgactccccgtgcttctcgggggacagcacggctagctgctgctgcggagcccacagtggggttctgggggggggggtgcaggcagaaggccgccatgcctccctccccctttccaccccagtgagagtgggctcgaaggcagggagtctgcccgccttgtggagcctccgcagaggcacccagggctgccgtgagcgcacagcctggcggtgtcccacggccctgccctttcctgtcacttccacctgttgcaaaacactgtgctttcgtatcttttctttctacctgtttggaaatgtgaaaatcactgctgccgtaggaaacgggcccagatccgggctgtggctctcccatccgcaccgcccccgcggtgtccagccaggaggtgggaggtgggcggcactcagtgtgcctggttgcggcgatgattggcagatgcttggacctatggtaaagaggattttcgcgagctgggagtcagtcctggactttgtaggtctttacatcccaggcggcctttatggggttccagcatctgctgaggcccctgcgccagccatgtgaggcctgggtgtcctcgaggcctctgtttgtgcccctctctgggcagcgggagggagagctctgagacccagagggagctcaggggctgggcagccgcagaacagcgggggtaatgggtccactgggggttctgggctgtgcacacagtgggcttccggtgcccagccagctggggcaggcctggaatgttggttcctctctcaggatctggggcgctgctgtagctgtcggggaatcagtgaggcggctggacggcccgtatatcccacaaacgccaccgtattgctcaaactggactcaattttcttaacacctttttttttttttttttttttttttttggagacagggtctcactgtatcgccgaggctggagtgcagtggcgcaatcatagctctgggctcaggtgaccctcctgcccccaaggtagctgggactgcagatgtgcaccaccacacccgactagttttttgtagagatggggtttcgccatgttgtccaggctggtctcaaactcctagactcaagctatccgcctgcctgggcctcccagagtgctgggattacaggtatgagccactgcttcgccacgttcacctttatttacttatttatttatttttgagacggagtctcgctctgtcccccaggctggagtgctgtggcacgatcttggctcactgcaagctccgcttcagcctcccaagtaagctggaactacaggtgcctgccaccaagcctggctaattttgtttttgtatttttagtagagacggggtttcaccgtgttagccagtatggtctcgatctcctgaccttgtgatccgcccgcctcggcctcccaaagtcctgggattacaggcttgagtcactgtgcccggcccacctttttattttttattttatagagacaagggcttgctgtgttgcccaggctggtcttgaacccctgaccttaagtaatcctctctggcctcccaaagtgctgggattacaggtgtaagccatagtactgggcctaaagttcaccttttttttttttttttttttttttgagatggagtctcgctctgtcacccaggctggagtgcagtggcgtgatcttggctcactgcaagctctgcctcccgggttcacaccattctcctgcctcagcctcccgaatagctgggactacaggcgcctgccaccatgcccggctaatttttttgtatttttagtagagatggggtttcactgtgttagccaggatggtctcgatctcctgacctcgtgatctgcctgcctcggcctcccaaagtgctggggttacaggtgtgagccaccgcacccggcaaagttcacctttttaaagtgtgtaattcagtggcatatagtacattgacagagttgcacaactatcacctctatcagcttccagaacattcttgttaccccagaaggaaaccccgtctctgtcagccatcactccccattccctccccagtcccggcacccacgcattcccttcctgcctctggattggcctgtcctgaacatttcacacgagtggtgtcacacaccgcgtggccttttgcgtccggcttgtctcacggagtgtgctgtcctcaaggggcatccgcgccgtggcctgggtccgaacctctctgctgttcacggctgcgtcactttccagtgtgtggagggccacgctgcgtttgactgctcatctgtggctggacacttgggctgctcccgcctctgcctgtgaattgtggctgctttggtgcacgtgtgctcagccggcgtccctctagaatccttgagggccttgtttcagccacatcaggagggattcagggaccagggcacgcgggtctggagctgggtgttcctgggtctccatgtgcctcccagtcctgctctgagccgtgggaggccggggcgagggccaggcccatctcttccctgtatgatctgtttctaggcagacggaggctcctagccccacctctctgtgagcttgagtggcgtttatgactctccttcctatttcctgtcctgctaatcaacaagtcagctaaacagtccatgctgcctgggcaagcccagtaggcccctaacgtggcacctcggagcggctggcgatgccccaagagccgggcttccccctcctggaggctcttcctgttcctcgccaagctcttaggtttcgctgggcctcctcttctgctctttttctggctggagacgtcagaggaagcctggcgatctagagaagctgatgtgcacccatcatcccggaggtgactgccaccaggcgggggtggctccacccccactcctcccctggcataaatcgggggacgcacgtgcctgcgcagaatgccttggtcccttttaattaaacagacaacccagtgtcccttggtctatgctgacctgctcaggagtgcctgggctcttccacgtttcagctgctgtgtgtcctgctgctgtgaagtgtccccgttgaggtggaggcagggcagggcgccttcggtgagggcgagtcctcctgtgcccgtttccccatctgtagaatgatggctcatggaggagacatggtgtcggcaggtggtggccggcgcagggaggtttccaggagggagtcctccaccctcatttgcttttagggccgtgcagcctcccgagcggcccccacgaggctctgaggctgcatgcaggttgagctcctggcctcactgcccctcctcagggttaggactgtgctggagcctgggtgggtgtggggtggtccctgcacaggcagcaggaggtgggccagagcggtgctggacctgaaggcccgtggctccctcagctccactgaggaggctggaatagtgtcctgggccaccttccctgccggtagccggctcctgctgagggagggggtgctttcgcctcctggtggagcatcaggctcttggggcctgtgcgtccgagcatctggcctctgctgtctgaaaacagcaccttccccgccccccggccaccgcatctcctctgaatagaaggcaagtcttgcctcccaggaatggcctgtgaccttcatcagcgggggaggttaggggcacacagagccctggggaacaaggggatctggggctgagccgggcctctcgggcccaccccgagctctcctgagcagcctggcaggcaggaaggcgctgggccccggggcctttgccgagcccagcctcaccctcagcgtccccctcaatgccctgggtgcctgccaggctgtggacacaggccctggccagttctataaataaccttgccgggccctgctgggaattggtgccaccaccacatagcccagagagaacggaaacacagggcttctcagcgagcagaccaggcctgcggtgaccagtggaagtgggggacgctttcagggctgggcagcccgacagggcaccgggcacagccaggggccggaaccagttgctcactggctccgcttctgggggactgtgtccctctgtgccccgtccccatcacaccttgctttcccttcatcctgctctcctagcccctccccagactggcggccccttgtccaggcccagccccagcacagcctgcagccctggcagagctcaggccttggccttctgaggttgccctgagggcagtgagcaatgagccctgggactggtgcactgggagggaaaggtgagccaaggcttcctgcaagaggcagccctgagctgggggtggggaaggctgggtcgtgggatacccctgacaccccaagttttttttttgagatggagtcttgctctgtcacccaggctggagtgcagtggtgagatctcgactctctgcaacctccgcctcccaggttcaagcgattctcctgcctcagcctcctgagtagctgggattacaggcgcccatcaccacgcccggctaatttttgtatttttagtagagacaaggtttcaccatgttggccaggctggtttcgaactcctgacctcaggtgatccacctcggcctcccatagtgtcgggattacaggcgtgagtcaccgcgcctggccccccagctgttttttatgctccatgcttgggcttcctgttaagaattaaaaaagaaaaaaaaaactatggagatggaatttacatactgtacaactcattcgttcacagtgtacaattcagtggcattaagtacattcacacggctgtgcaaccactacttctaattccagaacgttcggtcaccccaaaagcaagccccattcccattgtgtcactctccatcccctccaccagctcctggccactctgaatccacttcctggctctggattggcttgtcctggatattgcatagaaatgggatcctgtcggccgggcgcggtgactcacgagagcaagagatccagaccatcctggccaacatggtgaaaccccatctctactaaaaatacaaaaattagctgggcgtggttgcgggcacctgtagtcccagcgactcaggggctgagtcaggagaaatcgcttgaacccgggaggcagaggttgcagtgagctgagatcatgccattgcactctggcctggcgacagagtgagactccgtctccaaaaaaaaaaaaacaagaaatgggatcctgtcatcccagcgttttccgaggccgaggtgggcagatgacttgagcctagtagttcaaacgagaccagcctgggcagcacggtgaaactgtctctactaaaatacaaaaattagctgggcatggtagcacacgtctgtagtcccagctacttgcggggctgagatgggaggatcgcttgagcctgggaggtgcactccagcctgggcgacagggaaaccctgtctcaaaaaaaaaaaaaaaagtgcatcacacactgtgtgtcctttagtgtctcactgtgacatcctcaaggtgcagctaggctgtggctcgagtcagagcctcactggtttttgtggctgagtcttgttgagtgcgtggatgggctgtgctgatcctcgtctgtggaagggcccctgggtggttccacatctcggctgctgtgcgtcctgctgctgtgagcatctcgtgctccgtttctgcgtggcgtgtactgttcctcagggtgtgtacctgggagtggagctgctggctcacagggtaacagacctttggagaagctgcagacgcttccacgcccacccactgggtgtgaggaccttgctcctcgtcatttttgtttttgtttaattttttcttttatgagacagggtcttattctgttgtccaggctggagtgcagtagcacgatcacaggtaactacaggctcaagtgatcctcccacctgagcctcccgagtagctaggacttgaggcacgtacctccacacctggctaatttttgtatttttagtagagacagggtttcgccgtgttgctcaggctggtctcgaactcctgagctcaggtgatccacccgcctcggcctcctatagtgctgggagaaatgaagtgtctgcgacagggcggcagctgcagagggggctgtgctctctggcctgttgtgccccacccttgtgacaggcaggtgggcgtggccaactgggcggcagctgcagagggggcagtgacaggcgggtgggtgtggcaggaccccacaatgtctctttctgtggcgtctccttcttcgcctgccccttcctatgggccatccttccagctcacctgcggcccaccctccaaggagtgggaccctcggagttgggagcccttggctgcgtgggactgtactgtgtgacggagccatcaccagggctccaactcaccctggctcctgccacagtctgggctccatctgtgctaccattgcagtagtctggtttctaggaagcaaaactgttactgagttacaaagctcaattaagagtgtcctttgggaggccgaggcgggcggatcacaaggtcaggagatcgagaccatcctggccaacatggtgaaaccctgtctgtactaaaatacaaaaaaattagccggctgtggtgacacgtgcctgtagtcccagctactcgggaggctgaggcagggaaatcacttgaacctgggaggcagaggttgcagtgagctgagatcgggccaccgtgctccagcctagggacagagcaagactctgtctcagaaaaaaaaaaaagtgtcctaactgtgtcctccaaagccctcgccggccgatgacagactagagggcgctgtgctcccaccccctaccgccctgagcctggacgcgtggcccctgcagggccctttcccacagcactgtgaactcacagcttctctctagggaagggaggaggtacgccacttccacagggagatggggaggccgactccagggatccaggccatcatcctgacgttgggtcggctgatacacccctgtcctctctgtcccagggaaattcaactactgaggaggttacggcacaaaaatgtcatccagctggtggatgtgttatacaacgaagagaagcagaaaatatatcctttccggtgttgggaccgcggggcctccgtgggaggggctggggccctgggtccgcctgcctcgaggcctgctcctcttcccgtctccttgaaggagactggcacacgagggccgtggccttccctggttccccggaagtcagccattgtggcaatggctgcgcagcttgctgaaaggggccctgagccctggcccctgtgtcttgggcccgtggggtgtcaagtcccttttttctcagagtctcctcccaggctaaccaggggtgtagccacggtctgcctgagacaggccacgcgggctgaccgttgtgggccattttggtcgtggctgggcgtgtcctcgtgtcatctgtggacacccccatgggtcttacgggcacagcctccctacggggactttgcttcctaaggccctgtgcccagagcaagagccagaagtggtcctgaggctggggctgtgttccctgagccacgcggtcaggggccctgggaccgtcctgcatgggcccgagcctgcttgggggggcgtccaggaggcaccatcccccgcccatgggcagggtgggggacgtgagccccgcaggaacgctgccccaagagtcagccctgtcctccccttccccgtaggctccttcctcctgggacgctggggcccctgggccttttcagaggggtggctgagggcagggtgggccctggtcccgaggaggggcaaggtgggtgcagagggtccctccagagccccttttctggcccccgtgctccctgggcctgtgagtggggccgccccctgagctgtgtgtccttagcgccccacgtatatggtgatggagtactgcgtgtgtggcatgcaggaaatgctggacagcgtgccggagaagcgtttcccagtgtgccaggcccacgggtgcgtgcgcggggcaggggccagggtggggcgggggccgggggccaggcagggcaggctcctttccgtgaggccacactgcttgtcctgatattcattgacatgaaggcccaagtttttttgtttttttgtttttttgtgttttttttcgagatggagtctcactctgtcgcccaggctggagtgcaatggtgcgatctcggctcactgcaagctccgcctccgaggttcacgccattcttctgcctcagcttcccgagtagctgggattacaggcgcccgccaccacgcccggctaattttttgtatttttagtagagacggggtttcaccgtgttagccaggatggtctcaaactcctgacctcgtgatccgcctgcctcagcctcccaaagtgctgggattacaggcatgagctaccacgcccggccttgtaaaggcccaagtttttaaaaacagttttggggtcccccatgtgtggcatccacaggcagggctgctgccaacctcccgcctccatctttgctgggcctgctgcctgaggccagtggcctgcttccagcccatcgctggcagccgcctgccctgaccagatctcctggatgcaggtctgtggcctcagagtcagggccccttgctgctgcaggaccacaggggcagggaggggcctgctgttccagcaagactttggggtgcagccggcctgtggcccacaggaaaatgagacctgtggacatccggggccctgccagacgtggctcggccggacgagggtggccactgcaggcgcaggtgtggctccctgctggacctagcctttcctctgtcctgtgtgcctggacttctgtgacttcccagctgggcctgtggtgtttgggaggctcccaggcagctgcaaaggggacccctgtgaggggcagggaggcctcggccccaggacgggtgtgtgctgcccgcaggtacttctgtcagctgattgacggcctggagtacctgcatagccagggcattgtgcacaaggacatcaagccggggaacctgctgctcaccaccggtggcaccctcaaaatctccgacctgggcgtggccgaggtaggcacgtgctagggggggccctggggcgccccctcccgggcactccctgagggctgcacggcaccgccacaggcactgcacccgttcgcggcggacgacacctgccggaccagccagggctccccggctttccagccgcccgagattgccaacggcctggacaccttctccggcttcaaggtggacatctggtcggctggggtcaccctgtaagtgccccgcccccccgggcactcaccacacgcacactccgaggggcctctgcgtcttgggcagctgccggcctgtgggcgcagggcgtggccaccggcccagaccctctctggccacagccgctagggggtgcttactttatggaaatgtaactcatacggcagatggtggttcacccgtgtgaagtgcagcctggcccgtcagggatcttcacagagtggcacggccgaccctcctcccagagccccacagggaagctgggcgggtgacagcagctccaggccccttccccgggtgggtccagaggacactcccctcctaccccgtagcctccactagtggaaggtggtgaagacagaggtgtccttgagtccacagggcctctggtccagcagccacgggacgcctctgtccctggggtagagctggggctcctagggcgtcaaccaccttgactgaccacgcctttcttccctcccctcgaaatgaagctacaacatcaccacgggtctgtaccccttcgaaggggacaacatctacaagttgtttgagaacatcgggaaggggagctacgccatcccgggcgactgtggccccccgctctctgacctgctgaaaggtgggagcctcatccctctgcccgcagccccagggaggcggggcttttgtgcagaaatgtagggttgggggtgtcaggtggggggctattggccccgagaccccagcaggcattgagaggactgagtggagaggccgacctccccgcagggcctggtttgccaggtccctcagctccaccctgcttctgggccctgttcaccctccgaactcccaccccagagggcagtgctgccctgcgcctcccccagccccaccctcgggggctccctggcttgcagggtctgtcagggttgtcctgctgcacttcctacgcatggcagcaggtggcactggccgtccgtccatctgcccagtggccttgggagaacggaaccgccctggccgtccagcccagccctgtctccctgccagccgcgcacaggctgtccccggcatgtcccaggagtggagtggcctctgtcagggagaccgcctgtgcgcggggtcccccttaggagcgtccaggtatcacccagggcctgacaacagaggctgggcaggcggggacggttggtggggtctcaggcctgtgcccagctgacaggctcctcgccggcttctcctcagggatgcttgagtacgaaccggccaagaggttctccatccggcagatccggcagcacaggtgagcggcccctgggggcagtggggccgaggctgcagggaggccggccatgtgggcagctggttgagcgggcgctagagcagggcgtggtgggggtgccaggctgggctggggccagaccccgtgcagcgcccgcagttctcggggcccgagtggggtctctgggcagtgtcctgttaccggccagacccaggcgccttgtccgaactggggtctgagtgaggacatgcgtccgtccctgccctaggcatggagatgcgccaggaagggcacagctggtcccaaacactggcgagagcctctctttttcccctcctcctggggctcccagcagcagggtgtggctgggatccagcccagggcccccagctccatgacagggaagacagagcagcggacggggtcagcaggccccacagtgccgcctccctcacttcgtgggctctgctcctctgcaccagcccctggaggcccttgagccgtctgctggagcccctccgagccccgaggccacccactgagaccggctctgggagtgggagtgtccggacccctgaggcgctggtgctgattgtgccttgggggtctctgcacagctcgggtcatctgggcgcctggcggggactggggctgccccccgatagcctcctgggctgggatgtgctcagggccccccagacccccttctggcctttgctggctttgcagccagcatccatctggtgggtgctggcttctgagtgccacctgggacacaggcctcagggtggaggggacatctgtcaggcttggagtcaggtcagcctgcctgctcctagaggacatggctgagcttctgtggtcacagccaccccttgcacggcctggtcccagctcctgagtgtgtggcaggtaccctgggcccagaggagctgggtcggaaaactggaccgccctggtgccagcctgacaggcgccactgcttctgggcgtttgcagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggtgagtctggcgggggcccctgcccggctctgctgactcggccaggatgtcccacgggagcagggtgcctgcctgtctgcaacaaggacagcttctgccctctggtggccaatcccacgtccccaaagcctccagcccacctgcaggctgcctccgccctgcgggccgctgggacatggctgaaaggtgtggggtcagcgggggcaccagcccaggcctgtctggccaggagggttcctcaggcgtctctccgggtgctgcccagccaggcaccacccaccggccttggcctgagtcccagcaggagcaggcgggggagccccagggtcgggggagggtaggtgagagtcagggtgcagggtggcccctcagacagctggcatgagagagggtccagtggccctccctcccgtcgtccctgaggcctgcccgctggccctgatgccggccgcccttcttccctaggtggcgaggaggcgtctgaggcagggcttagagcggagcgcggcttgcagaagagcgagggctcagacctttcaggagaggaagcctctcggccggcgccgcagtagtgcctgaggaggagctcagggccttagcgtaggggcggcccacattggcagccagcccctccccgccatgctcccggcttggctgtgttcggcccagggctgggccgtgtcataaagagttttgcagtgtatctgcagggtggatgcttgctgcgctcgggctggagcctgagggggctttctgctttactgtttcagcgggaagtggtgggcaggggccggcctgagaaggggggtacgccaggcaggttgggatgtgaggacccagtgcacagggtccacccccgggcccgagggtcccagaatagtgggggccctgcagagagccccccattaggtccctcagcactcctgggcccctcatcaaacccctaggctcagctcagtagctggtccccaggagagtacagtgtgggggcccccgagagcacagtgtatgggggtccccggggggtacagtgtctgggggccccccaggaggatgcagcatgtgggggccccccaggagggtacagcgtgtgtggggcccccaggatcacagggtctcagctcctgggctcttggatttgcagcaccacgaccatcgcgtctggtctgttggaacgggaggtgctgctgggtaccctggtcactagggtgtgctgggaggtgggggcccctcatggtgcccatccttggggcctggctgcaatttgaccccaggcccagggtcttctgcctttcagagccctggtgccctgagacgggcagccaggcaaatcccaggcaggagggccagttagggcagggccagcccaggcaggttgcgagagtccctactgggacgtggaccacacgctgacccccacggccgcccctgcaggccaggatccctgagccaggacccggcactggcttccctcctggggaccctcaggcctgtgtgagacctgggctgccctggggtgaggtgcctgggaggagagcaggggctgggccacctttttcatgaccctgctaagcccactgtgggtggtgaggaggagtacccagcagggggaagggccgccagaccactcggcatggctgaggcctcagtactcagtactgggtactcaggtggacgcccctcccactgctcagatgctggggacaggctcaacttcaggcttcagcgtgagccccgtccctgacctgcagagcccccttgcgttggggcaggacagcccggcgccctcgggtcaggccatcctctgcgctctgccggggctgctgcatcggcctctgcgtgcctccactttggcctcacgtgtccctacccaggatgcgggtcctgctgccaacacccagatcccagggaaggggcttgggctagatcctgggcaccagtgcagacaggagtgtggggtggggcaagggcccagtggcggctgtgcccgctgatgcagagctggggcaccttgtccacagggtctgccccaccagagacgggctgggcccaagctcagacctatgggtgcaattggtgcctcctcaccaaggtcttttttatctttttttttttttggagacagagtcttgctctgtcgcccaggctggagtgctgtggtgcgatctcggctcactgcaacctccacctcccggattcaagcaattctgcctcagcctcctgagtagctgggattacaagtgcgcgccagcatgcccggctaatttttgtatgtttagtagagacgggggtttcaccatgttggtcaggctggtctcaaactcctaacctcatgatctgcccacctcggcctcccaaagtgctgggattacaagcgtgagccaccgcgaccggcccaaggtgcttttttaaagctagtgacttcctgtgcacatggggtgggtgtgtggcaagttctggaagctgctgagtcagccactggtccattctcggagctggggctctgcactgggcacatgagctctggggcagcccggggcggcctcccactgacttcgcccgggaggggcctcggggatggctcggcagccagtgtgttcgcggagtcctcgccaaccaccacggctcctcgcagggacagtacgtgggcagcttcctgcactttcccctgccattgtgagaacagtgtccacctgggcagggtgggcagccccaggcctgtgggtttcaccagggtgctggtgatggttggtggctagcagggactgggggcagctgggggccctggcaggctgagctctgctccccgcgtggttctgtgctggcatttcgcgtgcctggcctgagcctggcccgagcctggccctcctgtgtcctcacagatgagcatgtggcggctcctgggcctctagaaccaaccatgggccagggtgccccaggggagcacgggagggtcctgccttgtcagcttgcctcctactcgtgaggttcctgcagtcagtacctgggtggggtcccacctgcggccatggcaggtgcaacagacgtggtggaggggacactcctgcccaggccatctgcgggaggctcagccccggggggtgcctcccagagctgctggggggcagcatttcaggctggatacacctgggcctgacccgggggcgggcatggcctgggcagcagctgtaagtgcgtccccgtggtgggggccagccaggtccctgtggctctggggttgcgcccctcagctcaggccacacttgccgtctccctcccaggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcaggtggggcgcggcggggcccgggtggggcatgtggggacaacgcctggatgccacagccagccgtgagcatagcccgcgctagtcagtcatggtgaccgtcacgtggctgcgcgtggttgccatgtggcctttgggtggcttggccacgtagcgatccccgtggagggtgccgtctcggggcctggtgtctggccagcgtgctggtcatggaggcctacgtgtggcggggctctgggggggcgtgccgtcctcacagccacctctcagagtgggtgcattccgaggaccctgccctgggcctggcgccccctccccatgcccgcgccgcttccaggaaaggcttatgctgggctcagcccagaggcttttgagcaccagtgggtggtgggtggtggggaggggccgcggcctccatggctctgccggggtgccgcaggctctgagccagctgccaagtatggctgaggctgagtcgtgccggacgctgccctgtctctccctgtgtgcctgcctcctctcccagccccagccccagccccgggtgggagacggagtcccagaggtgtcagagacccttaagtcacctgccgaggatgcggggtggatgggggcccgaggctgaagcccctgccttgccacagcccctctcccaggttttgggggccaccgcctgagttacatgtctgtcccccaaatgggtgcccacagcccatccaccagcgtcagagcccgccaggccccactgcaaaaggccacacaatgtaccccgggagtgactcaagggtggccttccctggcctcccctgctgccccccaggagtccggtagccccatgactgtacctcagcttctccatcctcccaggggcccgcgggaggcggagaaccggtgcccaggctgacctcttccgtcttccttccaccctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctg

SEQ ID NO: 33 - DNA, 146268 bp, Homo sapiens
ccggagcccgagccgaagggcgagccgcaaacgctaagtcgctggccattggtggacatggcgcaggcgcgtttgctccgacgggccgaatgttttggggcagtgttttgagcgcggagaccgcgtgatactggatgcgcatgggcataccgtgctctgcggctgcttggcgttgcttcttcctccagaagtgggcgctgggcagtcacgcagggtttgaaccggaagcgggagtaggtagctgcgtggctaacggagaaaagaagccgtggccgcgggaggaggcgagaggagtcgggatctgcgctgcagccaccgccgcggttgatactactttgaccttccgagtgcagtggtaggggcgcggaggcaacgcagcggcttctgcgctgggaaattcagtcgtgtgcgacccagtctgtcctctccccagaccgccaatctcatgcacccctccagagtggcccttgactcctccctctcctcactccatctttcctggcctctctccgggtgcttagcggacttggccaataacctcctccttttaaacgccctgaattgaaccctgcctcctgcgcatcctctttttgtgtcaccttagggttcagatttaactacgcgacttgactagtcatcttttgatctctctctcgtatttagtacttttagtcagcgagcatttattgatatttcaacttcagcctcgcggttaagagcttgggctctggaatcatacggctggaattggaattctgtcagtcgtgtggccgctctctactgtcttgtgaagataagtgagataatcttgacctgtggtgagcactcgtgagcgttagctgctgtatttaccaggtacagataagacaactacagtggatgataatgtatgtggtgataggggagtactctgatggtagaggagtgactttggttctctgcaaactcagcctgagactatcaattcagtttgtggtgagacctcgcagtgttaccttggcagatggtagaagccttccagatggaaggaaaaatgcgtgtaaaggcacaaagtgtagaaggaccctgaagctccagcgtgaggcctggcattgaatgaaatatattttgtgggttttcagctgctgaagtcataggaatggatgagaccaagaaaacaaagctgtttttgaggtatgagcggaagaagagatatcaggagactttcgaaacagtcataacggaagttaatatgatcattgctaacatttgctgtgtttcaggcactgtaagcatgtatatgggtccttaaagggactcatagaggtaggtactagtattgtttttccttttatcattgagaaactgaggtttgaagagattagtgaacttgctctagattatacagtttgtaagtggctgaaccaggatttgaactaatacaatctgactacagaggccacactccttagcactagaaaagaatggcatgccaagggcagagttatttctaggaagatgggatataagcgtcattgtcaagttgtgcaaaggggtcaacttggttgagatctaaaaaggaacactgaattcgtcaattcagaggctcgtaggaagtaggaaatccttatcttttcgtttgaaccttgagtggaacctagatattctggattaatgtataaatgaagttcatctttatatggtgacactcatactctagttgactacctaatagttcctctgccttctttcagttccgccaacatactgtgttctttaacattgtagaaccctttggctatgctagtctccttccctgaagtgttggtcctctagccctttttttgattggcaccagttagttcagatcttggctttattataaactcctctgagatatatgttccctgacagtttatctaaaatgattctctctacagttattttctattactgtgtttttgtttcctcagaggcatacatcacaatttggaattatgcattggtttatcaatttacttgtttattgtcaccctgctgcccagatatgacttcatgagggtaggatttgtatctgtttagttcattatttgtctagctataagtagtaaatattgtttgcatctatcagtgaatgagcatcttctgtttatgtagataatactgaactgttttgttttcttcaaagtaatcattaagctgaaggtaagaaaaacaagttcaaggaagtcacaccatggggaaaaaaaagtcaagtttagggctgcctcttccgggaagtgtcaaatctttagtatatttaggaataaaggtgccaaaccttatggttctttggatattgctaaggtattttcattggttagattaccagtttcattttccttattgactcaagagggctttaaactgagattgaagaagtaagaagattcctagataaaaccataaggaatggaaaaacaaaaatgataatacttgtccacaggaagtatataatcaaatgaaaagaactcaaataacaatctgtaatctatagcagagtaaagcggaagttgtaatagtgttgggggatgggggaagtcagaagaaccaccagtgaatataaaaggagaagagaatcagagccatctgctaataaaatgggtagtcagctctttttgttttttttgtcttgttttgttttgagacagtctcgctctgtcgcccatgctggagtgcaattgcgtgatctcagctaactgcactttccgcctcctgggttcaagtgagtctcctacctcagtctccccagtagctaggattgcaggcacatgctaccacacctggttaatttttgtatttttagtagagacggggtttcacgatgttggccaggctggctggtctcgaactcctgacctcgtggaacgcccacctcggcctcccagagtgctgggattacaggcatgagccaccacgcctagccccggtagtcagctcttactgagaatattcaaagacagggcattcattttgtaagagacattccttccttcataggaagattggacctggtcttttagttcctcccaattttgagattctgtgagattgaatcggggcagagaaacatacttaatcttgaaagattaagtagaatttagatggatggataggagaaggactttccctacctttttacttcttgagatatagttatttgtaggtataatatacataaatatatgtattttttctctgtttacagacattcatagtttaataaaaaacttctttgtattatataaaggtttagatcagaactagtaaaacagaatgctgtttctttttttttcttttctattttactttaggttctgtgggtagatgtgcgggtttgttacatgggtaaattgcatgttgctgaggcttggtgtacgaatgatcctgtcactcaggtagtgagcatagtacctgataggtagcccttcaagccatacctccctttctttccaaccctcaaacagtccccagtctctgttcttcccatctttgtgtccatgttgaaatgctgttcttactacatttttttgaaggacatcaaaagagagtttgattatatcagaagcccccaaaagaagagagctactcagtggaatcaaggcatagtaaaatatagttgatccttgatatttgcaaaggataccaccatagcatagaatttgcttcatttccttttaaaacagaaatgtcattttactcctattgttatgtgttaaataagaaccttaataccagttgagatggaagtggtagacaaagcttactagctctgataacctcctacttatcagctccaaagcatgttttaagcctttggctcagcaaaatgacatgtctctccatataagcaagagtgcttttttttttttctttgagacggagtcttgctctgtcaccaggctggagtgcagtggcgcgatctccgctcactgcaacctctgcctcctgggttcaagcgattctcctacctcagcctcctgagtagctgggactacaagagcacactaccacgcctggccaagagtgcttttaaatagttcattgtcaatgttaaatccttgagtgctcatttccttatttacctggctgttttctattcatctttcatgtctcaatttaaatgtcatgtttctttggtctcagagtaataaaaagtaaatatacttcccccatctcccgccccgcagagccttcctctgttgcccaggctggagtacagtggctcgatcttggctcactgaaagctctgcctcccagattcaagcgattctcctgcctcagcctcctgagtagctgggattacaggcgcgcgccaccaagcccggctaatttttgtatttttagtagagacagggtttcaccatgttggtcaggctggtcgaactcctgaccttgtgatcctcccaccttggcctcccaaagtgctgggattacaggcgtgagccactgcgtccagtgtaaattatacttttattttaatcctgctactactgcaagcaaggcaaacatttttgtgttacagcattacttgtatagattttaagaaaatctcattttaaatacggaaatgttaagaaaaattattgtgcctttgaccagaatgtgcctctaattgtacagttaaatctaactataaatactgcagtataaaataattatatacacattttttcacacctctttctctctatatatgcatatatacatatacatatatatacctatatgtattttttttacagacagtgatgtgtgttctgaaattgtgaaccatgagtctagtacttaatgatctgcttatctgctgccgtcaactagaacatgatagagctacagaacgaaaggtagtaaattacttaaattcaatttttccttgaaataagtgtgattagtaacccattattatttcctttttattttcagaaagaagttgagaaatttaagcgcctgattcgagatcctgaaacaattaaacatctagatcggcattcagattccaaacaaggaaaatatttgaattgggatgctgtttttaggtattctattcaaatttattttactgtctttatttttctctttcatatttatttctgttgtgatattacttttgtgtgtaagtcttaacatttatctttgcttcctatatatcattatgccttgcatatgaatttggcatttaatatttatccaaaacataatttttaaaggttgttcatatagaaacttaaaaattataaattatttcttcaataaaatgttttagacatatctcactcaaaattgagagagaatttctttcattttagttagttcacaagacttcagattagaggaaaaaattataataaatgttaggatattattttcacacctttaaatattactctgattataagtaaatgctgtgtgttaaattgtaataaaacaagtaaaaggaagattggaatacttgtgtatgaatttggttaaaaacaaaaaatacctcgaacaatgaaaaaacacaactgattgctggacaggagtggcaaacagggttgatgcatttttacattgagacatcattttcaaccgtgaaatccatttataactagaaacagattgtaaggattaggaaagatgaataaagtattttaaatactgagagtattaaataaactagaaataacatttgtagtcaagaggaagtgtgtatttagttgtccttcagtgtttatgacagattctgttttatttttagctcctgtttggtattagattgactgttacagatttgaaagcatataaaatgaaacatgcatgctgtttttcctctgattttctagtttattttaaataccacaaatataattacaacctgaagatgaatactattttgtataagctgatctggtaggtcaaatatgcacccagcattcctggctagttatgaatatcttctaggcaggcttaatttattggctggcaacattaccaactgcctaagaaacaggtagatcctgtacagaataacagaaggagttgagagaggattgagagggtccttactagcattgtaagcttttaatgacaaatttagaaaacaggcagtaaagcaatagaaagtcatagaagattaagagctttgcagaccagatattaaattggtcttgtaggagttaggccttgaaagagagatttaattgttttatttgtttttttcagctgatgtagtaatctaagcaaggtggtttaaaagttgctctttgtgatggcatgaacagcttttgaaattattataatttaagtattcaacgagtttctgaaattgcattttgttttcttgaagatttttacagaaatatattcagaaagaaacagaatgtctgagaatagcaaaaccaaatgtatcagcctcaacacaagcctccaggcagaaaaagatgcaggaaatcagtagtttggtcaaatacttcatcaaatgtgcaaacagaagtaagtgatgttataaattataaataaatggcttaacagattactgtcgcgtgagttttttttttttttcagatcattttaaggacttaactgttgcataagtttgttctaaatagaataagataaaagttgagtgtaagtacatataatgatttttatttttattaaaaggtttttttttagggctagtcaagtgaagcagtgggagtttagaaggaacaaagaaatctgtaactggttgtgatcaattcgttgtaaacaccactgcactcaggccagcctgatttttaatattacaagttcaaatatttggggaaatttatgcaagcatagaatgacagaaatctgaggattgaagggatttatttatttaagagatagggtgtcactctgtcacccaggctggagtgcaatggtgtgatgatagctcactgcaggctgaagcttctctgttcctaagtgatcctcctgtcttggcttcctagtagctaggactacagaagtgcatcaccatgccaggctgatttttttttttttttttaagaggtgttatttcactgttctgcccaggctgatcttgaactcctggcctcaagcagtcctccccctgctcagcctccctagttattggtattacagatgtgagccaccatgcccagtgaaggaattaaaaattactgtttaaactacccagtcttggatgccctctctacgtccctagcctttaggtagaagtgcagtcttcatgattgaatatactttcaaggctttcttttccatctttgaatagcattaacagtattaaaaactggccaggcgcagtggctcattcctgtaatcccagcactttgggaggccaaggcaggcagatcacctgaggtcaggagatcgagaccagcctgaccaacatggcaaaaccccgtctctactaaaaatacaaaaattaattgggcattgtggcgcacgcttgtaattccagctacttgggaggctgaggcactagaattgcttgaacccaggaggcagaggttgtggtgagctgagattacgccactacactccatcctgggcgacagagcgagactgtcaaaaaaagaaaagtattaaaaacctgtcttttgttactgcttctcccttctgagagtatatcaaaaactcctatttatgtttttagtgtgacatccttagagatgtttgaaagtagccacaatatttcctaagtcctcatctctaaagttcataatctcactttcttcagctcacgtgacctaggttttatgctactctcctctgaatattcttcactttaattgtctgtcttaaagtgtgggcctctacttacagggaagaggccagaaaaacaaacaaaaaagtgtgggactcattttttttaatacaggctcttgctctgtagcccaggctggagtgcatgcagtggtgcaatcttggctcactgcagcctccgcctcccaggctcaggtgatcctcctgcctcagcctcccaagtagctgggactataggcatgggccaccatgtctggctaatttttgtatttttaatagagacagggtttcactgtgttggccaggctagtctcaaactcctgacctcaagtgattttcccgccttggcctcctgaaatgctgggattacaagcgtgagccactgcacctggccaggactcaatcttttaggtatattctgattagtacagagtgaagcaattcttgcttatctttcattctgtactcttactgattaattctaagatcatgtgagcttccttggctgtcagaaccaacacttaactgacattttacttgctatgatttgaggaaaaaaacaacccccaaaaatatttttttctcctgatgagccaaatagttcccatctttaacttgtacaattaatattgtgaagagttgatttttcggaaccaaaatgcaggatcctggcaagcttttgtaaggaaatgggctttacacatactgaaaagctagaggcagaagtgtgtgttcagggactcctgggctcttcacagataaggatgttgctttgtgataccaactcttaatttaagaatcaggagtgtgaggcgcggttgctcacacctgtaatcccagcactttgggaagctgaggcgggcagatcacctgaggtcaggagttcgagaccagcctggccaatatagcgaaaccccatctctactaaaagtacaaaaaatagctgggtgtggtggcgggtgcctgtaatcccagcttctcgagaagctgaggcaggagaattgcttgaacctggaaggtggaggttgcagtgagctgagattgtgccattgcactccagcctgggcaacaagagtgaaactctgtctcaaaaaaaaaaaaaaaaaaaaaaagaatcaggaaagcccccaaattggtaaatatttagtagaagtatgcagattattagtgaatatttcagattggtggtatgagacttgagtccaaagaataatggtttagtcaattttctacctcctctgagatgcgagttcgtgtggatagcttcaaccccttgtcagagactccagcagagacaaaggaaaactacaccaaaatattctgcactcacttttgctctgtgtagtagctttgtatccagtaaaatattttatttgctaataatgctgggatatagtaggtacttactgaaagagtgaatgagagaaagataacatgtcaattttgtagcccaccagaaaagtttgcaatgtgtacagtagttttgccttgcagtgaacaaaccttttaattgcaacattaacaatggagattacgtttgaaaatgcatcagcctgttggtttataagaaatagttggtgaaattatcaatgctggtcatgtaagtagttgaaaatttgtttttttatttacggcttccttttctttcaaatttgactttgttacttaaacctttttaatattggggcaaaaccagggagttactattccctcaccccacttcagttgtttttgtttgtttgtttgtttgttttttacgaaaagattggagggttgatggaaatttaacatatgtctaaactttgccattcttgcttagcattggtatccaaggtatgatgaaagaaatagagattagtaaaaaagaagtaaaaggcagctgagaagaaacaagtaagcaaatattgttgatttctctccttttttttttttttttttttttttttttttgagacagagtcttgctttgttgcctaagctggagtgcagtggtgcagtcttggctcactgcagcctcttcttcctgggcgcaagcgattctcacgtgtcagcctctagagtagctgggactataggcacacgccgccaggcccggttaatttttgtatttttagtagagacgagggttttgccatgttggccaggctggtctcaaactcctggcctcaagtgatctgcctgcctctgccttccaatatgctgggattataggtgtgagccaccacactcacacacccagcctactgttcatttcttttctttttttttttttgagacagagttttgctcttgttgctcaggctagagtgcaatggcgccatcttggctcactgcaacctccgcctcccgggctcaagcgattctcccgcctcagcttcccaagtaactgggattacaggcatgccccaccatgcccagctaattttgtatttttagtagagacggggtttcaccacattggtcaggcttgtctcgaactcctgacctcaagtgatccacctgccttgtcatcccaaactgctgggtttataggcgtgagccactgtgcccaccctgttcatttctttatgttagcatttgtctgcttttgtacaaagcttaaatagagtctagatagtgcaaaactcagctgcgaaaaatgttaagttccataagattcctgaaagtctctgtaagtaggctgggcacagtggctcatgcctctctaatcctagtactttgtgaggccaaggcaggcagattgcttgagcacaggattttgagaccagcctgggtaacatggtgagacctcatctctacaaaaacacaaaaattagccaggtgtggtggtgaccacctgtagtcccagctacttaggaggcttagggaggaagattgcttgagcccagggggcagtggttgcagtgagccacgatcatgctattgcactccagtctgggtgacagagtgagatcctgtgtccaaaaaaaaaaaaaaaaaaaaagtctctgcaggcaacttagttgtacttttaagaaagatttgatcccagaagtttgagaccaacctgggcaacatagggagaccccatctttaaaaaaactaaaaaaattagctgagtgtagtggtgcttgcctgtagtcctagctacctgggaggctgacatgggtagatcccttaagtccaggaggtcaaggctgcagtgagtcataatggggccactgcactccagcttgggtgacagagcgagatattctgtctcaaaaacaagcaaaactatgaaaaaaaagtcaacatttcttgaaatacttctcatatttggtagaggagggagatatattgggataaaggacataggaagataggattttattataatattaatttctgtagttattcaacacaaattaatttttattgagcatttgctattagggcagtcactgggcttttacgtcagaatatagagattaattcctttccttaaggatctaatcatacaatggatgttttagattagaaaaatgttacaaggactataagagaaatgcacagggtactagaaaaaaggatcacatggttgtgcatttcataactggacaatgcctaaaattatgaagtgagccataagtgaagatgattttgcagttatatcagtgtatatttgtttaccatagcctgtgaatataactagtttcatcataggaaaaccctaatccagaatatattcatatttacatgagttgtgttctgctcatagttatggcaataaatatattcaattttaagattgtcagtatggaaaaatggcatttctgctgtgacgtaaatataatttactgaaaatgataattaaattatttttaaatgtaattttgttaccttcaagaatatgtgtgtagtcatgccaagttttcagaatctctagtaagtaaataacatgctgttaaaaatgacacaggtacaggggtcaagcacagtggctcatacctatagtctcagcactttgggaggccaagacaggagaatcccttgagctcaggagttcaagaccagcctggggaacattgtgagagattctgtctctatgaaaaatttaaaaaattagctgggcatggtggcacaacatctatagtcccagttgctcaggaggctaaggtgggaggatcccttgagcctgagaggttgaggctgctgttgggtgtgatcatgccactgcacaccagcctgggtgatagagcgagaccctgtcttaaaaaaaaaaattacaacctgaggtgtttgtatgccataaatgctattataggacttagaactaattttgctttccaaggtaaatattctccttgtaatcttatgttattctaataaattcattcttcataaagagtgccaaaaaacttgggatcatttttggtctaacaccagaaattgtgaattattaaggttataattgtttaagaatgattgcttttcgagatgagcagatcacttgaggtcaggagttcaagaccagcctggtcaacatggtgaaaccctgtctctactaaaagtagaaaaattagcagggtgtggtggtgcacgcctctagtctcagctacttggaggctgaggtgggagaattacttgaacccaggaggtggaggctgcagtgtgctgagtttgtgccactgcactccagcctgggtgacagaccaagattccatctcaaaaaaaaaaaaaaaagaatgattgtttttgctatatattcctataaaagaggcgttggcaaacttactgtgtaaagaggccagatagtaaatgttcttgactttataggccatgtggtcacctctgtcttaattacaaaagcagccataaacaataagtaaatgaatggttgtgactatgttccaataaaatgttatttgcaaagaaaaaaaaaatgaattttgcttggggccataatttgccaatttcttctctacaaaagaagtttagttaatagtaatttcccaaatggaattatttaaatagttgccattccaagtgtcttatttttgttcaaatttatgtttttctttatttgtttattttgaaataggagcacctaggctaaaatgtcaagaactcttaaattatatcatggatacagtgaaagattcatctaatggtgctatttacggagctgattgtagcaacatactactcaaagacattctttctgtgagaaaatactggtgtgaaatatctcagcaacagtggttaggtatgttttgaaggttgttgtttgtgaatttttcctcatgaaatgaaacttcaccaaagaaagcactctgtctgtatctgtctatatcccccaagtgacctgacagtttaacagtactttagtaaaattatatggttatcgaactgacccttaatttttatttattatgtagcttttgaataaagtcatgaataatatatcaggtgcctgatatcagagccggaattacagttgaaaaataccatctccatcgtcaaggagttgacagtggcagaagaaaacccaagtaaaccagagttcataatgtgctgtgatacagacatatttgggttcagtaggtatacaaaacaatgacacctaaactcaaccatgatttaagtagaaagggagaaaaccaagagagggaagtaccataaaagtgaaagcaggcagggtgcagtggctcacgcctgtaatcctagcactttgggaggccaaggccggtggattgcttgagctcaggagttcaagaccagcctgggcaacatggtgaaactctgtctttaaaaaaatagcggaggtaatggctcttgcttgtagtcccagttacttgggaggctgaggcaggaggatcacctgagccctggaggttaaggctgcagtgagctgtgatcacactgcactccggcctccatgacagagtgagaccctgtttccatttaaaaaaaaaaaaaaaagtgaaagcaagagagttgaaagttcaaaggggcgtggccaacattttaagtgttgtagaaaggataagacacaaaagtatccattggatgaggcagttagcacgctacttctaaggtaatggaaatcaaatatattagaatagaatgcattagaagacaatgtacagaacccagtgattcattagatgtgtagagtgtgtgctagggaggaatctggtgttgtttcctgtttatagctgggaggtactgagagaccacaaaggaaggaagttatggtcagagattgaaatacttcagtttgttggtttcaaagatggagcatttctgggtttgagaataagtgaaagtaggatttgacattaacaagatgattttaagtcaggtgtcaaagtcttctaatacacgaactctaaaagtttagaagcttttttttttcatggaaagtatttaagctaaattttgctagctaaattaaaagacatttgtccatattctttattgccattttattatttcaaaatgagatacatgtgaaccacaaaactactacctaatcagtaccctcactcctgcattacactctactgttcccctgagaataaatgccttctcagctaatttcttaggagtcatttgtagcctttacgttactctgaacacaagataggctgtgtctgtaacagggccctcaacaagcctagagacagcctttgggaataggctggtgatatctaggttacctaaccagatctttccccagtatggctggtcatatttaggtcattttacattatcacttacaaccatggctgtcactgaaacaaaggcagtctttcccctagtctgcttactatattctgtcatctagtttgttctctgaaaccccctttttatttttaaactaactactcttacttctttttttttcttttttctttttatttaagctaacctttgccacttcttcccggatgttacttcttataattagcttttttgtcaaagtatttttttacttagcttccttttaaaacttgcttagatgaggactctgtggaagaagcgaagtctgtgctcaaaatatatatttggtacaggtggtgactgaagccatgactatggatgagatttgtatatagagtttagtgtgagatgagaagaatggcctaagattgagtcagcatttgcatataaattttggaatcagcttactgatttctacaaaagatcttgctgggattttgatactaattgcattgaatctgttgcacaatttgagaagaatagaaatcttaacaatgtggagttttccaatccatgaacactgtatatctctccatttacttaggtttttttttttttttttttttttttgcttctttgtttgtttttttgagacagagtctccctctgttgcccaggctggagtgcagtggcacgatctcacctcactgcaacctccacctcctaggttcaagcgattctcctgcctcagcctcctgagtagctgggattacaggcatgtgccaccacacccagctaatttttgtatttttagtagagacagggtttcctcatgttggccaggctggtctcgaattcctgacctcaggtgatccacctgcctcagcctcccaaagtgctgggtttatagacttgagccaccgcgtctggccacttgtcttttttgatttctttcattagtgttttataattgtcagcatatagattttttgttgtaaattgacaattttttttctttaattttatatattaaaaaaaatagagacaggatctcactgtgttgcctaggctggtctcaaactcctgggctcaagtgatacccttcccttgacctcccaaagtgttgggattataggcatgagccaacatgcccagctgcaaattgacatttatttataattgtataaacataaagattttgtatatgttttgttagatttatactgcagtagtttgtaattgcattgtttttaacattttgattttcaaattgttcaatgcacaaaaattatacagaagtccagttaatttttgtatagtgaccttgtattttgggaccttgctaaaatcacttactaaatctagtagctttctttgaatgttcttttggattttctttgtagacaaacatgtcttctgtaagcagtaatttttttttctttctttctgagccatgtggcttttattttatttttgtgctttattacattggctaggacctccagtgtgatttattgtggtaaaatatatataacatttataattttaacttttttaagtgtacagttgtgtagtattaagtgcattcatattgttgtgtaatcatctccaccatccatctccagaacttttttttctatactcagtaaacaatgatttaccattttcccctcccctatcccctggcagctaccattctactttctctctctatgaatttggctatttggggtacttcatttttatggattgaatgttgtgtcccaccaattatgttgaaatctaactcccaaagggatggtatttggaggtgtgggatttaggaggtaattaggtcctgtgggtccagccttcatggatgggattaatgcccttatgaaaagaggccagagagctaacttgctgtctttctgccatgtgaagatacagttcaaagtcagtagtctgcagccccaaagagggccctcaccagaaacccacaatgctggcacctgagctgctttcagcctccaaaattgagagaaataaatttctgtggtttctaagccacctaacctataatactttgttatagcagcctgaagtagaggactcctataagtatttgtccttttgcaacctgcttattacacttaccaaaatgtctttgaggctcatcagtgttacagcttttgtcagaatttcacccttattaaaaactgaacactattctgttctgtgtatatgccacattttgttaattcattcgtccattggtggacatgggttgtttctaccttctgattattgtgaataatgctgccgtgaacatgagtatacatctcctgagtttcctgctttcagtcttttgattatatacccagaagtagaattgctagatcatgtggtaattctatatttaattttttaaggaaccaacatcctgttttacacaggagctacgccattttacattctcaccagcagcccacaagggttccagtttctctacattctcactagcacaactaatagaaaatgaggattcctcttctaggccttgaaagtgctgcataattttgcttcttcctacctgtctaacttaactaaagcgcttctaatttctgtgctcaagctacactgtcaattattcagtttctcaaacctagtggtttccatttttttaaattgacttttatcttttagaggaattttaaatttacagcaaaacggagtggaaagtccactggacacacacagcatgccctactgtcaacatcttgcaccagtggtacatttgttaccatcagtaaacctatgctgggacacatcattattatccagagtccaaggttcacttttggtggtacatatgctatggattttgacaagtgttttgacatttttaaagatctttttctgtatctaatgagatggtcatatttttttttcctctgggagagaatggtaacaatttttcactattacagaatcatacagaatactttcactgtcagaaaaatcctctgtgcttcaccttttcatctcttccttcttgtaaactgtgggaaccatggatctttttgctatctccatggtttagccttttccagcatgtcatatacagttgtgcgtctcttaacaatgtggatatgttctgagaaatacatcattaggcaatttctttgttgcgtgaacgtcatagggtgtatttatacaaacttagatggtataacactacgcacctaagctatatggtattactgctcctgcactacaaacctgtgcagcatgttactatactgaatactgtaggcagctgtaacacaatggcaagtatttgtgtctctaaacatatataaacatagaggaggtacagtaaaagtatagtataaaggataaaacatggtacacctgtctagggcacttaaccatgaatggagcttgcaggactggaagttgctctgggtatgtaaatgtgtggtaatgtaaaggcctgggatactatatactactgtagaatttgtaaactcttattctgtaccaaatttaaaaatttatgtttttctttcttcaatactaaagtaacattagctactataacttttttactttataaactttaaaaatgtttaaactttttgactcttttgtaataacacttagcttaaaatacaaatgcattgtacagctgtacaaaaatattttttccttatatacttatagatgttttttcttttgttctataagctttttaaatgaaattattattactctattttttcctttaaacttttttgttgaaaacaaagacacaaacacacacatgagcttaggcctacataaggtcaggatcatcagtatcactgtcttctgtccctgcatcttgtccccctgggagatcttcagggacatgcacagagctttcatctcctatgataatggtgctttattctgaaatacctcctaaaggacctacctgagactgttttactgttttgttttgttttgttttttaagaagaagaaggaggaatatagtataaaatggtgataaaaagcatagtagagtaagtacataaacctaacattttaccagtaacttagtcatttattatcattatcaaggtttatgtactatacatgattgtatgtattatacttttatatgactggcagtgcagtgggttttttttacacaagtatcaccacaaatgcttgtgagtaatttcttgtgctatgacatcactaagtatttaaataggaatttttcagttctgatacaatcttacggtaccaccttttcatattgccatttgtcattgaatagaatgttgttatgtagtatgtgactgtggttggaatcataacagtatgtatcattttcagattgccttctttcatttagtaatatgcatttaaggttcctccatgtctttctctttctttctttctgtctttctttctttctttttttttttttttttttttttttgagatagggcctcactctgtcacccaggctggagtgtggtggtgagatcatggctctgcagcttcgacctcctgagctcaaatgatcctcccacccccttccaagtagctgtgaccacagacacaagccatcacaccctgctaatttttcatttttagtagagataaggtcttattatgttgcttatgccagcagcttgaactcagcctcccaaagtgttgggattacaggtgtgaaccaccgttctcagctcctcgatgtctttttatggcttgataggctgaagtgggaggatcacttgagcccaggagtccaaatctagcctgggcagtgtagtgagacttccgtctcttaaaaaaacaaaaaacaaaaaaaagaggaccaaagttactgatattagaaatgaaatgagatctaattgcagatcctatagatattcaaaggataataaggaaacactatgaacatctattaatttaaatgggccagttcctcaaaaccatacattatcaaaagtcatccaatataaaatagataatttgactagtcccataactattaggagaataaattgaatccataatttaaagcctttcataagacaaattgggaacaagataaggatgtgcactctcaccactccttttcaacattatgttggaggttctagccagggtagttagacaagaaaaataaaaggcatacagattggaaaggaagaaataacactcccctttgtagatgacatgattgtctatatataaagtcccaatatacacaagtataacattgtgaataatgttatttggggactgggcacagtggcttacacctgtcatctcagcactttcggaggctgaggcaggtggatcatctaaggtcagatgatggcttcctctaaaacaggacagatttacttgtagcctattgattataaaaagcttgaggtttctctgttataactcagtccactgttttcgcagtgtcaagtgtcccatttcaccttgcctttggtactggggaactgatgcaaaaatgaaggtagtctggctaccatcattactgggagaaataaactgtcctttttctcttatcaggaatctcaggtttcctgctagcacccaggaaactgtcatgctaatttgttaggttacaagtagataaaatctcagccaggcacagtggcttatgcgtgtaatcctagcactttgggaggccaaagcaggtggatcacttgagcccaggagttcaagaccagcctgggcaacatggtgaaatcctgtctctacctaaaataccaatcagttgggtgtggtggtgtgggcctctagacccagctacttgggaggctaaggtgggaggattacctgagtctgctgagattgaagctacagtgagccgtgatcttaccaccacacaccagtttgggtgacagagtaagactctacctcaaataaataagaaacaaaccaagcagagtaaaatttcatacccttcataggtctcaacacattttttgcatattattaatcaaacagtattattattttaaaaaactgtggaggccaggcccagtggctcatgcccataatcccagcactttgggagaccaaggtgggtagatcacttgaggccaggagtttgagaccagcctgaccaacacggtgaaaccccatctttactaacagtacaaaaattagccaggcatggttttgtgcgcctgtggtcccagctacttgggagactgaggcatgagaatcacttgaacccaggaggcagaggttgcagtgagccaagattgcaccattgcactccagcctggacgacagagcaagattctgtctcaaaaaacagaagaaagaaaaacccatggagcatgtactgtaagtgctttcttaggcctagatgatggaacagaggcttagagaagttaagtaatgtttctgcgacctggctcttaaactggtgctctcacagcagtttatagttattcctgtcttaaaggcattttatataagataaaattaaatactgatggagtacttttactatgttaaaaataaattagtgcagttttaaaatcctttttctgtatgggattatggaatatttaagttaaattgtaacatttaatacattttgatttttaaaaaatcatgactaataatttttttttttttttaagaattgttctctgtgtacttcaggctctatctgaaaccttcacaagatgttcatagagttttagtggctagaataattcatgctgttaccaaaggatgctgttctcagactgacggattaaattccaaatttttggactttttttccaaggctattcagtgtgcgaggtaatctaatctctttttcttttgttttgtattgaaatacttttgatcttgcaagaccatgttttagactcagtaactaaaaattctaccttaaaataaaacattgatccatcataacagaactagtggattcctaaagagacaaccaagtccaacactttctgaatatccaatatgcagaacactacgtgaagttttcaagggggagatgtgtcttgctgatgttctgttgaccaggaaagttaaatatcctctaagtcattgcatttcccccattttgaggatggttttaatataccgagaataaaataaaataggaaaatattttggaagtattactgttgtacattagtatggcagtactcaatgtataatgtgaaacattttataaatggtgttacaaatcagttttgtttatttttatacaatgttttagcaggagggagagctaacagaagtggtctcttaacaccaaataagaactaattttttgtcagtgtgaagtaatgctgtgatttttttttttaatgaatagttttgaaattaagactactgtttgaaaattagggttttgtttttttttctttcagcataccacttcataactgttcagtttgtacagtttgttccccctgttatacccagttgagcttgtttgtttcttcacagacaagaaaagagctcttcaggtctaaatcatatcttagcagctcttactatcttcctcaagactttggctgtcaactttcgaattcgagtgtgtgaattaggagatgaaattcttcccactttgctttatatttggactcaacataggcttaatgattctttaaaagaagtcattattgaattatttcaactgcaaatttatatccatcatccgaaaggagccaaaacccaagaaaaaggtataaaggaaatgtttactgttttgaatttgcttcttcattcaaacatagaagtctaagtataaaattagtgttctttaggaggatatgactttcctctggatttctctggttgataatgttacttagccatgagaatgtttttcatagagtttttagaatttgaagcagtggtagcagattctgttatgcctttctatttgttcaatacaatattaggtattatgggaaatacaaaaaaatctgagacattgttccctctaggagctacttatgcatcaatacttagatactaaggggtctgacacagactgtagggcaaaagaatttaaagaaagcaggatcttgtttatccacctattacttttattagaagataaaatacgtaaattggactaaaaccagtcagattattcagctcctgaggaagatacatacatattactttaataggaatttgaggcagaaacagggaaattgctgccttaagcctcatagttactctagggccctgtttgccctagagtatcacttgttaaggagaatcacttattctccttaattccttcatatatgtcctataccaagagagtattgcccagaaggtatagtgcttttctgtagttaggaactttattggctggaactggagtttcctcttgctctgtctatgattgcctttgggcttatactagcctttggaccaactcatcatggctagtatagtgactttcttaaaacagcataccacattgagtaatagcagctataatggaggaaatgtcttgtagccactttttttttttttttttttttgagacagagtctcactctgtcgcccaggctgaagtgcagtgacgcaatgttagctcactgcaacctccgcctcctgggttcaagcaattctcctgcctcagcgttctgattagctgggattacagatgcctggcaccatgcccagctaatttttgtattttaatagggatggggtctcaccatgttggccaagctggccttgagctcctgacctcaaaccatccacccgcctcagcctcccaaagtgctgagattacaggcatgagccactgtgcccggccgtgtagccactttttatcaaaagtagctgtgtatttgttttatgggctcttctaataagtatatctagataatatgtagcccatgaaactactataagtgaaagaatagtgacttttaatagtttttcatcttttactcacctcttatctccaggatgaagatcaggcttattaggaggtgatatgatatgtttagggatttagttaactgcatatttagggtgaatttaaaattggcaggatgatgaggatgccagaaaagctaatgtagtttcagactactttaatagattttgtagtaccttgtttgtgagaaataatagaccttttgtttcgcatactagtcaagccacagttggattaccatgttcaccagattttgtatagtcagcattttaagttgactggaatgtgtcttgggaaagatgactgaaatggtgagaagtctgaataatatgtcatttttacactagttgaaggaactcgtaatatttttctcttaggccagaaaaaggcatacggagaacttggtcctcatatgaaagagggaacatattaattgtatttgcctcaggtgggagaataaattggagaaagacagattttaggtcagaatatggaagaaatttataagaaacacagttatctaaatgtaaaatggacagttatgaaatagagtttgtcaaggatcttgtcagaagaggcattagtactgaatggaaggttggaccaggtgtcttctaacgctgatgcagcttgacagctgaataattttgtgggagctagcagtgtaaacagagtacatacataaaaattacattttaattttttggattacaggtgcttatgaatcaacaaaatggagaagtattttatacaacttatatgatctgctagtgaatgagataagtcatataggaagtagaggaaagtattcttcaggatttcgtaatattgccgtcaaagaaaatttgattgaattgatggcagatatctgtcaccaggtacagtaagtaggtcatgtcacatttagaaatttcctgttaattttttttttaaactgggcattttgggcttttaaaacctgtgttctcacaaaaagcctataaaatgactctgtacatgcaactattcctttcaaactatcagaaatatttggaattacccttttaacttaaaagttaatgcttttgcagatatttgaaaactaacaatgaactttttcattcttaaatgattgtctctaggaaataaggtgaccctaaccctaatgattcgattcgactcgactgtattctacaaagtgctgggattacaggcatgagccaccaagcccagtctgtttcttttttgcaattaagctagagttcacatagcataaaattcacgattttgagttgtacatttcagtggtttttagtatttttactatgttgtacaaccatcatcactaattctggaaactttttttattttatttttatttttttgagatggagtcttgctctgtcacccaggctggagtgcagtggcacaatctccgctcactgcaacctccctttcccgggttcaagtgattctcctgcatcagcctcccgagtagctgggactacaggtgcctgccaccacgcccagctaatttttgtttttttagtagagactgggtttcaccatattggccagcctagtctcagactcctgaccttgtgatcctcctgcatcggcctcccatagtgctgggattacaggcgtgagccaccgtgcccagcccagaacttttttatcatcccaaaagaaacctcatcccttcttagcattcagtcccaattccctgcatctcctagatcctggcaaccagccactaatcaatcttggtttttgtggattttcctgtttgggacagttcgtttaaatggaatcatacaatatgtgagtcttttgtgtctggtttctttcactaagcataatgttttcaaagttcatgttttaccatgaatcagtacttcattcatttttattgctgaataatattcagttgtatggatatactccattttacttacccatccatcacctgatggcctaatgtttcttaaataaaactctgttccccagagatttggttaacatcctgagtagtaatttcactctgtcaaatattttcttaatatttcttaaaatttcttaaatttaaaaacttgaatccctttgaaagtaaaggtttttgctttacttttagatttcttagtgcttttagtaaatgttcccaggaaataaaactaatgcattacttggtaatacctgctttctaaagtgccattactgtcatgcaaaatgtttgtttcttactatgttatcagatttatatgtttctgtaatgtattactcttgctttatgagttccctgtatcttcatttcagaaagaattttttttccccctaatgaaatattagaagacaatagcaatgaaaaaagtgtatttggccaggcgtggtggctcacacctgtaatcccagcactttgggaggccaaggcgggcagatcacctgaggttgggagttcaagaccagtctgaccaacatggagaaactctgtccctactaaaaatacaaagttagctgggcatggtggtgcaagcctgtaatcccagctactcgggaggctgaggcaggagaatcacttgaacctgggaggtagaggttgtggtgatacgagatcgtgctgttccactccaacctgggcaacaacagcgaaactctggctcaaaaaaaaaaaaaagaaaaaagtggatttatttttattttacaggtttttaatgaagataccagatccttggagatttctcaatcttacactactacacaaagagaatctagtgattacagtgtcccttgcaaaaggaagaaaatagaactaggctgggaagtaataaaagatcaccttcagaagtcacagaatgattttgatcttgtgccttggtaaagtgttaccattttctcattcagtgtcattttaatctcttgtatgttatttttcagaaaactttcagtggaatcctttcatctcaaccagaactaagtcatttgtctacccccaaacctattactagcaaagggatatgtgattgccatgacaaatgagatcaatcattaatggctcatttgcttgggccaagtgcagggccacctattttaatcatattgtcatagcaagttaagaaggaggactggctctctgataggcaattagaagtgtgcacctcatggaattcactgaattgtacgcttcaacaatagattttagcatacgtagcaccttctaatagaattaggaagaagttaaagataatcttaagaaatcacagaataattttgaccttatgccatgataaaaagttattttctcttattttctatcttctttattctcatgtaacgttcacatatatttaagtaatcaaataaattatggatactttggaatcccaaaatattagatctggtaaggatgtttagaatttatctagttcagcctgtttgctttactgaaaagaaactgaaacccagagaggttaagcaacttctgtagggacagagatttatagattatagtcaaactcgtgatcagtgctcttttgattaccatgttgatggaatgtttaagtgtaagtgacttctggggaaaagcatattgatttagatacctattgcttaagctcatttttatatagttaagagtagctatttaagattcttaatttgtccttttagtcaagagtaatttattgaacacctgttatgggctaagcgttagatatacagagatgaataacataagactcctattcttaagtatcacacattctagagaatacacagcaaatgtttattggattaactgaattaatgtaaaggaaaaacagttttttgggtttctttgttttcctgttttagaggaatcgtttggtgactaaagagcaaggatgtacaagataactcagaaataaaatattgctaaatatatatatatatatatatatattttctgagacggaggctcactctgtcacccaggctggagtgcagtggcacaatcttggctcactacaacctccacctcccaggttcaagcagttatcctgcctcagcgtcctgagtagctgggattccaggcatgtgccaccatgcccggctaatttttgtatttttagtagagactgggtttcaccatgttggccaggctggtctcaaactcctaacctcgtgatctgcctgccttggcctcccaaagtgctgggaaaccacctggcccaaatattgctaatttaatatcctttaaaatatttgtttaagggaaacttaacagcttacccagctagccaaacgttgacaattttcctgccaatttaggaagtaggacatagtaactattaacagccagtttatttttagagtactatggaaatgatggtgattctctaattaggatattgtaagagtaccatgtctatatatttccttttagtttgttaatgtgatggaatagttttcaaattatcctttttttttttttttaggctacagattgcaacccaattaatatcaaagtatcctgcaagtttacctaactgtgagctgtctccattactgatgatactatctcagcttctaccccaacagcgacatggggaacgtacaccatatgtgttacgatgccttacggaagttgcattgtgtcaagacaagaggtcaaacctagaaagctcacaaaagtcagatttattaaaactctggaataaaatttggtgtattacctttcgtggtataagttctgagcaaatacaagctgaaaactttggcttacttggagccataattcagggtagtttagttgaggttgacagagaattctggaagttatttactgggtcagcctgcagaccttcatggtaagttcagcatgcattatgtctgacttacagataaacacacacagacacacacacactcacatatccctgatcattttcatagtttgttacttcagttaaagatgtcaaattctatttcagatgcttttcttgtttggccgagaagacttaataaatgcataagtgaatttagtttcaaatgttgacaaattattaaagactaatgttaaggaatttcttttttagttaaaaaatttttaattgatctataatagagttatatattatcaaggtacatgtgataatttgacacactcatatgacacactcatgtagggtgatgggatatcagcaccctacgtatcttttcttcatgctaggaacgtttgaattattctcttcttgctgtttggaaatgtacaatagattaatgttaaccgtagtcaccctactgatgtatcggacaccaggtcttattccttctaattgtatacgtgtatccaaaagactttctttaaagaattatgaagagtttaaatttcttttatgtgcaatttatcattatttattaaatagccatgtttaaattgtagtactatgcactgttaataaacgagctattttttaatcaagaatcttcccaaatgtaatcagacttttaacagtttttatgttcatttagtcaccttaactaaatgtatgtgccaggcactgtcctgatagataaagtctttgcccctccaatagcttgcttttcacaattgtcctttgttttgttatagtcctgcagtatgctgtttgactttggcactgaccaccagtatagttccaggaacggtaaaaatgggaatagagcaaaatatgtgtgaagtaaatagaagcttttctttaaaggaatcaataatgaaatggctcttattctatcagttagagggtgacttagaaaatagcacagaagtgcctccaattcttcacaggtaatttaagttcattagcatgctgctgttttttttgtttgttttatcaggctctctccacttatttgatgccagatggctttattttataataataatgcagaatttcccagatctaaccttaattattaaatattatgtttgtttttacagttatctgtgtctttatgcctgattgcttctgaaataaagggttgtctcactgtgagaatatgggggatgtgcatgaaaaatgcacatataattctttgagcatttatgtgttcctttctgattttttaaataagtaagtccatatatttgagtcatgtagatcctggatcctttctcataatgggagtgtcttttgggtaaaagatgttttatgaatgaggtgaggaaacgaggaagacaaaacaggatgtaagcactaggataaaggaatggagtccctcgtccacttaacctttccacagattggtaattggaaccaaatgattggagagcagacctccgaatggatccaattaaagtacttttgctttaattttacaaccttttatttatttcagaaataatgttaaacatgctgtttctaaacagtattggaaatgataataacaatggttgtcctccttaaattgtccttttagatattaagaaatttagtatagatgaaagcaattttaatctaggatccaaattttagaagtcaagatttatagctaaacatggatgttaaagtttaaagtattctttacatggcttttggtcttctaagtgaagctttttgtttttctttgtagtaattttcctcatcttgtactggagaaaattcttgtgagtctcactatgaaaaactgtaaagctgcaatgaattttttccaaagcgtgccagaatggtatgttatctaataatgctctttatcattttaagctatagctttaattacaaagatgataattttagctgggtagtagctgcatcttaataattgtaaactaaattggtccaaaaaaattgcaactgttagccagggaagaggttgttttaattcagtgattgtaatctatgttatataacattagaccaagcttactattttttaatgctgtatagtataatatgtgacaagtgccaatgagaaaaactgaatggttatgctgggaaattaagaatataaaatttatatgaaataagttcttaaagatgttacccatttctgtacatcaactatgatttgactatttgttagctttaaaaactaatgataattgaaaacaaaaataaatctaaacctgagtttagttgattgactcaagagacttagattgtattgctgtgactgaaaatgactcactggcacaaacattccttatctccctcaagagggcaaaaggatgcgtaactgcttacctataccagatgttaaaggtttttaaacctatgctctttacttcctctgcttggtgaaaaaagggatatgtttgcagacaatgttatgcttaacatttatatctggtgtttttaaaaatactttctgaatttgcctttgagattgtaacttgtattttttctctatctattagtaaaatttgctactgaataatgacatttgatataagtaggtctcaaagtccgaagaagagaagcatttaaaagaataatctattaattatataagtagtctttgaatgatgtagatactaggttaatgttttcctttgtaatatattgctaatacatataaggcaaagcattaggtacttggtttatatattaaagatcttactttcttgaagtgaacaccaccaaaaagataaagaagaactttcattctcagaagtagaagaactatttcttcagacaacttttgacaagatggactttttaaccattgtgagagaatgtggtatagaaaagcaccagtccagtattggcttctctgtccaccagaatctcaaggaatcactggatcgctgtcttctgggattatcagaacagcttctgaataattactcatctgaggtgagattttttaaaaaaagaactaagcttatatatgattcaactttggtaaactgttaggaaggagaaataggggcaggaaaaacagcaaggatggtgggaggcttcattttaaaagcaaagtggcagtaaagggctctaaattggacaacttagcataattaaaggaaaactcaagaataataatttgagtacttcctttgtactggaaattatggtagacataaaataattccttgtgtaggttagtgaggaatagtaagagtttgagcatagggattatatgatgaaaaaaacctctaaatacaaaggagggaaatgttacagtaatagaaaagaacacgatgtaaacaaatctaatagattttggtggcatctgaagagagatgagtgattagtaaagacaataaatggactagcaattattttagacgtcatctaggaatttcctttagcctcaaaatcacgagttctcttcatgtatactattctcttgccaaaacttgcattttttaaaatgtgaaatgtctttctacctatttctgtgtattcagatcatccacatgtgaaaatccttgctaacgcctttcttagaatctcagaaagtaagattctaagaatttttatttttgagacagagcctcgctctgttgcccaggctggagtgcagtgacgtgatcttggctcactgcaacctccgtcttccagttcaagcaattctcctgcctcagtcttccgagtagctgggacaggcgagtgctaccacgcccaggtaatttttgtatttttagtagagatggggttttgctatgttggccaggctggtcttaaactcctgacctcaggtgatggacccgcctcagcatcccgaagtgctaggattacaggcgtgagccacggtgcctggcctaataatttttcatcttttaatttcatagtacttaatgtttcacatttttaatggcagttagcatcttctttataccatggatatttacatatggtttgtatacaaatatctcttgaactataactcttaaacataaactcttaaaagggcatacatgtttttatttatctttatatcctccacagtgccttattacatggtaaatgattaaataaagcctacaatccattcaaaggagtgaattcggtagccagggaaaatgacttgaggacatgagaggggacagtgtgcctctttatgatctttactgacattcttctgcaccacaattgtaaccactttcattacaaagtaatttagttttgtatattttctcctaaaatgccgtttcctaccctgtaggaacaaaaaaaatctgaacattttgtgtgtaacttagcagattcttagtaattctataaaattgtctaaactttttttttttttttttttttgagatggagtcttgctctgttgcccaggctggagtgcagtggcctgatctcggctcattgcaaccttcgcctcctgggttcaagcaattttcctgcctcagcctcctgagtagctgagattataggtgcctgccatcacgccctgctaatatttgtatttttagtagagacaaggtttcaccacgttagccaggttggtctcgaactcctgacctcaggtgatctgcccgcctcggcctcccaaagtgttggggttgtaggcgtgagccaccatgcccggccagctgtcaaaacttgtatctactagaaaaaatgttttatgctattctgtggagtctaaaaagctgaataagtcaaggttcctattcttcagaagcttaaaatgtcattttaatgtctctttatatgactgtaatttctacttgtgttctaagacttacagtcatttatttgcctgtgaagctttttttcttttctttcatccctacctcaaatatttaagggcctatgtgtacagtacaccctccaccctaagatgatatatcctgcttggccatcaggagatacttaggctatttttcttgagaatcctggttataattctacagtgatctcctagttgtttttagagctatccaggatatgccacctttaactcagttaactgaacttttgttttttaatatgtatgtagaatttgttcttacaaaagatagagtatactaaattatttatgaaatatatatatttttatttgtggtttactttaagattacaaattcagaaactcttgtccggtgttcacgtcttttggtgggtgtccttggctgctactgttacatgggtgtaatagctgaagaggaagcatataagtcagaattattccagaaagccaaggtaggagaatttatactaataaagtttcggataaatttgaatgaaatgtattcctgtgaaaattattacatttgtttggaagacattaaattttatgcaggttaaccctttctcttttatttatgtaatgtgagaagaaattatactatgtattttttaaattgttttaattgtttaatttttaattattattatactttaagttctggggtacatgatgtagagcatgcaggtttgttacatagatatacagtgccatggtggtttgctgcacccatcaactcgtcatctgcattaggtacttctcctaatgttatccctcccctagcccccgaccccctgtcaggccctggtgtataatgttcccctccctgtgtccatgtgttctcattgttcagctgccacttatgagtgagaacatgcagtgtttgtttttctgttcttgtgttagtttgctgggaatgatggtttccagcttcatccatgtccctgcaaaggacatgaactcatccttttttatggctgcatagtatatcatggtgtatatgtgccacattatctttatccggtctatcattgatgggcatttgggttgcttccaagtttttgctgttgtgaacagtgctgcaataaacatacgtgtgcatgtgtctttatagtaaaatgatttataatcctttgtgtatatacccagtaatgggattgctgggtcaaatggtatttctagttctagatccttgaggaattgccacactgtcttccacaatgattgaactaatttacactcccaccaacagtgtaaaagcattcctgtttctccacatcctgtccagcatctgttgtttcctgactttttaatgataggctgtaagcatgaaactctttcttatctcttggtagtactctgtcactggtatgatttgcaagaacagagtataagatttgccattttaaaaaattgttaatgagttttgcttatactgtatgactacgtggaacttctaaaaacatttcattttttctcttaagtgcactttattttttattttatagtatgtccaagatcaaagtacactgtaaaaagcaatactaaactataattttaactggaatttgcatttttccttctattcacaatagtctctaatgcaatgtgcaggagaaagtatcactctgtttaaaaataagacaaatgaggaattcagaattggttccttgagaaatatgatgcagctatgtacacgttgcttgagcaactgtaccaaggtaagattttcttcttcttgttttgttttttgagataggatctttctctgtcacccaggctggagtgcagtgggattgtcacaactcattgtagccttgacctcctggtttccagcaattctcctgcctcagcctcccaagtaattgggactacaggcatgtaccacctagctaaaattttctttttacttgaaagtgtagcctatgcagggaattgatcactggttggtgttactgttttggtgtccactcgtaagtttattttttacttttatttttcttttttttgagacagtctctcactctttcacccagagtgagtgatcacatcactgcgatccagcagcctcgacctcctgggctcacagcagcctcgacctcctgggctcaagtgattctcccacctcagcctccttagtagctgggactacaagtgtacaccaccatgcctggctgatttttgtatttttgtaattttttgtattgatggggttttacacattgcccaggctagtctcaaaccctgggctcaagtgatgcttacatctcaaagtgctgtgattacaggtgtcagctaccatatctgttcacattcataagttatacaaattgatttaaaattcagttgaatggtacataaaggtaatatccagacaaataagcaataggaatctgagtttctcatgaaactaattttataatttcaggaatttttctgagattgccttatgacttttatatacaaccatatagatgactcttttattcctgggacactttcattcatttaataaaaattttttgacccaaactatgtggtatgcgtagcggggctagtgagcaacacaacaataactccagcacatagtttactttcttttgctcagatcaccttacataacatttggtagaaagagtgctactgtgtttaatctttgtttttatctgcagcagcctgtgggatagccaagccaggccccagagtattgataataattggaaatatatttcaaacctagtattaggtacatggccatatagcaatattatcaacatatttcttggttttgtaatgtgtttttcctcctttttggtgtaagtggggaaggagaaaagtagaataaactctaacctataattatagctcacttatctttagggtcaatagctgttactttaatgttgttaaagcacaatgaaagatgtacagtatagttattataactctaagaaaagatgtgtttttgaagcagcatatatattggccctaatagtaaactatttatctacattccattcaagatagagaaaacactgtctgccaagaataattgtttttatttctttgttgcttggttctttgtttgtcttaattgcagaagagtccaaataagattgcatctggctttttcctgcgattgttaacatcaaagctaatgaatgacattgcagatatttgtaaaagtttagtaagtatgcttcctgttttgctatcatattttgattctaataggcataatttttttgttgaaatatctttgtaaataaggatgcatctcacaacatatagctcttaacatttttacaaatgtggaaattaaggccaggtgcggtggctcatgcctgtaaccccagcactttgggaggccgaggtgggtggatcacaaggtcaggagattgagaccatcctggctaacacggtgaaaccccgtctctactaaaaatactaaaaattagccaggcgtggtgacatgtgcctgtagtcccagctactcgggaggctgaggcagaattgcttgaacctgggaggtggaggttgcagtgagcgaagatcgtgccactgcactccagcctaggcgacagagcgagactccatctcaaaaataaaaaaatttaaaaaattaaataaaatgtggaaattaaataatttgtcttgtggggaaatatacctgattgcttcttaatatcaatacctagcatagtagtgcctgcctttagtttctcaataaataatacatttaaaaattgggaacgaatcatccaggctcacagctatatctgcgcaacattgtaccaaaatttaaaataattatttgttctttaaaagtgaccaaaaatcttgccaggcaagcaacatattcttattgtagtatttatttttcttccatacaaatgggcttatgccacatacattcttttttctggaacactgccgggcatacaaagtagttattgaaatatctattgagtgaaaacatattctgtaacttatttccattttatgacacatcttaatcattttccatgtcactgtacttattttataagctatctgctgttatactttatttatttagcagtgcatggtattctattgtgtggtgatagtgaatagtatatatgtatatgaaagcttatctgctcttttttttttttttttttttttgagacaaagtcttgctctgttgcccgggctggagttcagtggcacaatctcggctcactgcagcccccacctcctaggttcaagagattctcctgcctcagcctcccaagaagctgggattacagatgtgtgccaccacaaccggctaatttttgtatttttagtagagaccaggtttcaccatgttggccaggctggtctagaattcctgacctcaaatgatctgtccaccttggcctcccaaagtgcttggattacaggtgtgagccaccacactgagccaaaaagcccatctgctcttaattaacattttaagtggtttctagttttttgggttacaaagacttctgtggtacagattattgtacttttgtctatttgtatttgtgtgtatgatggatgtaggataatttctagcagtagacttgcttgttcaaaaggaatgtgaattttactttttgatggatattgtcattgtcctccaaaatagtcataccaatttaggcattttcctacaccctctttgggtaacactttaggtgttacaaaacttcttaatataagaaataattttgagggaggagccaagatggccgaataggaacagctccggtctacagctcccagcgtgaacgacgcagaagacgggtgatttctgcatttccatctgaggtaccgggttcatctcactagggagtgccagacagtgggcgcaggtcagtgggtgtgcgcaccgtgcgcgagccgaagcagggcgaggcattgcctcactcaggaagtgcaaggggtcagggagttccctttctgagtcaaagaaaggggggacggacggcacctggaaaatcgggtcactccccgaatactgctcttttgcgacgggcttaaaaaacggcgcaccacgagattatatcccgcacctggctcggagggtcctacgcccacggagtctcgctgattgctagcacagcagtctgagatcaaactgcaaggcggcagcgaggctgggggagggatgcctgccattgcccaggcttgattaggtaaacaaagcagccgggaagctcgaactaggtggagcccaccacagctcaaggaggcctgcctgcctctgtaggctccacctctgggggcagggcacaaacaaaaagacagcagtaacctctgcagacttagatgtccctgtctgacagctttgaagagagcagtggttctcccagcacacagctggagatctgagaacgggcagactgcctcctcaagtgggtccctgaccctgacccccgaacagcctaactgggaggcaccccccagcaggggcacactgacacctcacatggcagggtactccaacaggcctgcagctgagggttttgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctccaccaaaggaacgcagttcctcaccagcaacggaacaaagctggatggagaatgactttgacgagctgagagaagaaggcttcagacgatcaaattactctgagctacgggaggacattcaaaccaagggcaaagaagttgaaaactttgaaaaaaatttagaagaatgtataactagaataaccaatacagagaagtgcttaaaggagccgatggagctgaaaaccaacgctagagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgggaaaagaccaaatctacgtctgattggtgcacctgaaagtaacggggagaatggaaccaagttggaaaacactctgcaggatattatccaggagaacttccgcaatctagcaaggcaggccaacattcagattcaggaaatacagagaatgccacaaagatactcctcgagaagagcaactccaagacacataattgtcagattcaccaaagttgaaatgaaggaaaacatgttaagggcagccagagagaaaggtcgggttaccctgagagggaagcacatcagactaacagcggatctctccgcagaaactctacaagccagaagagagtgggggccaatattcaacattcttaaagaaaagaattttcaacccagaatttcatgtccatccaaactaagcttcataagtgaaggagaaataaaatactttacagacaagcaaatgctgagagattttgtcaccaccaggcctgccttacaagagctcctgaaggaagcattaaacatggaaaggaacaaccggtaccagccgctgcaaaatcatgccaaaatgtaaagaccattgagactaggaagaaactgcatcaactaatgagcaaaataaccagctaacatcataatgacaggatcaaattcacacataacaatgttaactttaaatgtaaatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccactacaggagcacccagattcataaagcaagtcctgagtgacctacaaacagacttagactcccacacattaataatgggagacttttaacaccccactgtcaacattagacagatcaacgagacagaaagtcaacaagtatacccaggaattgaactcagctctgcaccaagcagacctaatagacatctacagaactctccaccccaaatcaacagaatatacatttttttcagcaccacaccacacctattccaaaattgaccacatactgggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaccgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaagagcagaactgaaggaaatagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagcaatacaaactaccatcagagaatactacaaacacctctacgcaaataaactagaaaatctagaagaaatggataaattcctggacacatacactctcccaagactaaaccaggaagaagttgaatctctgaatagaccaataacaggatcagaaattgtggcaataatcaatagcttaccaacaaaaaagagtccaggaccagatggattcacagccgaattctaccagaggtacaaggaggaactggtaccattccttctgaaactattccaatcaatagaaaaagagggaatcctccctaactcattttatgaggccagcatcatactgataccaaagccaggcagagacacaaccaaaaaagagaatgttagaccaatatccttgatgaacattgatgcaaaaatcctcaataaaatactggcaaactgaatccagcagcacatcaaaaagcctatccaccatgatcaagtgggcttcatccctgggatgccaggctggttcaatgtacacaaatcaataaatgtaatccagcatgtaaacagaaccaaagacaaaaaacacatgattatctcaatagatgcagaaaaggccttggacaaaattcaacaacccttcatgccaaaaactctgaataaattaggtattgatgggacgtatctcaaaataataagagctatctatgacagtcccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccactgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttcttcacagaattggaaaaaactactttaaagttcatatggaaccaaaaaagagcccgcatcggcaagtcaatcctaagccaaaagaacaaagctggaggcatcacactacctgacttcaaactatactacaaggctgcagtaaccaaaacagcatggtactggtaccaaaacagagatatagatcaatggaacagaacagagccctcagaaataacgctgcatatctacaactatctgctctttgacaaacctgagaaaaacaagcaatggggaaaggattccctatttaataaatggtgctgggaaaactggctagccatatgtagaaagctgaaactggatcccttccttacacctgatagaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagacagaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaatccttttacactgttggtgggactgtaaactagttcaaccattgtggaagtcagtgtggtgattcctcagggatctagaactggaaataccatttgacccagccatcccattactgggtatatacccaaaggactataaatcatgccgctataaagacacatgcacacgtatgtttattgtggcattattcacaatagcaaagacttggaaccaacccaaatgtccaacaatgatagactggattaagaaactgtggcacatatacaccatggaatactatgcagccataaaaaatgatgagttcatgtcctttgttagggacatggatgaaattggaaatcatcattctcagtaaactgtcgcaagaagaaaaaaccaaacaccgcatgttctcactcataggtgggaattgaacaatgagatcacatggacacaggaaggggaatatcacactctgtggactgttgtggggtggggggaggggggagggatagcattgggagatatacctaatgctagatgacgagttagtgggtgcagcacaccagcatggcacatgtatacatatgtaactaacctgcacaatgtgcacatgtaccctaaaacttaaagtgtaataaaaaaaataataatttttaaagtttgcatattattttgttatgtagacatattacaggttatatatccattttactattgttggacatttagtagaaaaagtactgtagttttcatacttacacatgaaccttgaattgtttgattaggtaaattttttttttttttttttttttgagacagagtctcgcttcgtcaaacccaggctggagtgcagtggcatgatctcagctcactgcaatctctgcctcctgagttcaagtgattctcctgcctcagcttcctgagtagctgggattacaggtgcccaccaccacacccagctaatttttgtattttaaatagagacaaggtttcaccatgttggccaggctggtttcgaactcccgacctcaggtgatccacctggctctgcctcccaaattgctgagattacagatgtgagccactgtgcccagcctgattaggtaaattttgactacagcatgctcctgcaagaagccatcttgaacatctttgtttctcttccttgaaggcatccttcatcaaaaagccatttgaccgtggagaagtagaatcaatggaagatgatactaatggaaatctaatggaggtggaggatcagtcatccatgaatctatttaacgattaccctgatagtagtgttagtgatgcaaacgaacctggagagagccaaagtaccataggtaaatacatatttactacttgggatttcttttacttctttatattgatttggcagtataagaggcctcattgatatcaattttgtgcttatttcattttctcttagtatagccttttaggattgttcctttcttatatactttattttttttttatttttacttgaatttattagtttcatattttattcttcatagaaggaacttaagataactattaaagaaataaaaccaggccaggcatggtggctcacgcttgtaatctcagcactttgggaggccaaggcgggctgatcatgaggtcaggagatcaagaccatcctggctaacgtggtgaaaccccatctctactaaaaacacaaaaattagatgggcgtggtggcgggcgcctgtagtcccagctactcgggaggctgaagcaggagaacggcatgaacctggggaggtggaggttgcagtgagccgagatcatgccactgcattccagcctgggcgacagagcgagactccgtctcaaaaaaagaaataaaatcatatgataggttatttcctcaatagaaagcaggaaatgaaaacacacctgtaatgccattgcttttaacctttttctattatttctctgtagaaacattcaaaattgtagtcaacatcaacattcacatgttatgaatgcctgtttaattataagtatttttccaggtagttgcttttcttgatagtcatactttttaatggcttcaccatttttctgtcataaataccataatttacttgacattttttattgtcagaaatttagattcttttctattttcctacaataaacattattgcaatgatcatttgtctaagggtttttttttctcatattttaaattatttcttgacaacagaatcttggataatttttcaaaaagacttttgaagctttcagtatataattaatttcactataattttgcttttcatatacttttttttgtgaagaggaggaaatttgagttaatatgactatatatggctgttgtgcccttctcttagtgttaatgagtgctttttatttttaggtgccattaatcctttagctgaagaatatctgtcaaagcaagatctacttttcttagacatgctcaagttcttgtgtttgtgtgtaactactgctcagaccaatactgtgtcctttagggcagctgatattcggaggaaattgttaatgttaattgattctagcacgctagaacctaccaaatccctccacctgcatatggtgagttacgttaaatgaagaagctcttggattttatctgatgttgctgactaaatgtaatgagttgacatgtaagaatcacatggtgtctttgaagaattgaaattgctttcttgagaaatgaacctgagactagttggaaaataacacttttaacgtgctgtgagcaaatttaagtggatgctgaaatattaaaacttagatgggttttggatagatttattctctttaggtttaattgttataaattattttaattaggctaagaaacatagaccctgaatgtaaaaatattacataacattgtgtttgaagttggaaccttgcctttgaccttagtttatatattttcagttttttggatttgatttcaaaatgatagtgaagttacaagaatactacagttaacgttttaccatatttgcttaatcattccctctctccacacacacactcatacgcagatacacacatcattttctctgaaccattttgagatgaaatcgcacacgtgatgctccttatacttcagtgtatatttcctaaaaacaaggatacacttctgtttagccacagtataatcatcaaaatcaggaagttaacattttgtcattgcatttaggtgtgtagtctgtttagtctccttcaatctggaacagttcttttttttatttatcatgaccttcatatatttgaatagtacaggtcccttgctctgagtttgtctgatgtttccttatgattaaatttatactttgacgagaatgttgcaaaagtaattcctcttctgccttcaccctgtccatttatctgtctgttgatagatatcttcaaatccaagccaacatcacacagtttatctttttttctgtccaaatttataaattgctttactagcagttaaaaaaaacaccccaaaacctgactatccactcaacctgaatgcatttacttatttgctcaacaaccttatatataactaatctaaccatgtgggccattttcttagccctagccccagtgtatgtggaggtagagcctctggcctagcgagtagcaagttgggtcctaggtcatgtccccagttccagcaaattgtcacacatgcctggtgagtccctaattagaacctctgatcacagtaaattgtaggctgagtcattggtggaatccctggtcatgtttcccacccttggtgaaaatgcacgtcaatcccttagagtgagaagacaagtttggttgtgccctgtttgggcccctggtttaggtcctcgcagatactcaagtctctatccctgaccaagaggaagttacatgcttttcttgaagtattgatgtttcaagtcacttcagaacattcagtaacctcatgtacatgactctcatgtcaaataatgaaaaggatcatttaatttcctttgttaatatctgaaaaggattaagaaatatattattctatatgtaaataggaaaaaaaatcccttattatttcagtatagccagaaaattatttggtagttctcggaaactggctgcccagataataactaccattataactggtcgttgcagcagccctttctgtgcatagtaccataaagagccttacaagattgccttatgggaagataggtcaaggtttttgacttcttccctgcccatgattatctctgctttccaaaattcattaatagttttcaaccactggtctattatccccaagcattattttgggagagtggagacttacagtttcagaatcttgctcaagctcttaactgcaacagtggtaataatgatcatttattgaattccacaatagaagctagacttttacgtttattttctctaatcctcacagttatctggccaggtaagtgatatatcttcactctactgatgagggtacgaaggccctagatgacataaggcaagttttttaccagaaaagttaaggctgtggtactgggatttgaattttctgtttgacttcaaagccttttgtttttactatacacctcttaaatatttacagctgtgtgtgtgtgtgtatgtgtgtgcatgtatgaatttatgtttatatacttaaaaaaaatttttttttgagacggaatctcgctctgttgcccgggctggagtgcagtggcgcgatctcggctcactgcaaccttcgcctcccaggttcaagcgattctcctgcctcagcctcctgagtagctgggattataggcgcctgccaccacccctggctaatttttgtgtttttagtagagatggagtttcaccatattggccaggctgttctcaaactcctgaccttgtgatctgcctgcttcagcctcccaaagtgctgggattacaggtgtgagccactgcacccggcctatgtttatatactttttaaagtaaatgatttgtggataaacctgatttttttccctcctaccatcttagtatctaatgcttttaaaggagcttcctggagaagagtaccccttgccaatggaagatgttcttgaacttctgaaaccactatcgtaagaaattaaaaccttatgttatgttcactttaaagttataaaataactgatgtgttctgttaagcttataaagttgaactttttttttttttttaccacagcaatgtgtgttctttgtatcgtcgtgaccaagatgtttgtaaaactattttaaaccatgtccttcatgtagtgaaaaacctaggtcaaagcaatatggactctgagaacacaagggatgctcaaggacagtttcttacagtaattggagcattttggtaggtacagtctattttgtggtcctatttttcttttgctatctgtggatacgaatgcaagttttgtatccacatcagtgatttcttctgatcttcctacatagctaatacatcttttaagaatagcagaatgtaatttgtgtttccctcagtcgcttgaagaactacattgctttttgtttaaggcttggctttctaaaccgtttaactcatttctctgcaaattttgaatcacttaataatttgacatgtatagtgaataaaggataacaagccaaaatcagttgaattgttcatgttccctaagtgaacaaattggccttgtccttatctggttattttatgcatattgtcacattccaagataacaccctgatacttacagaggagcacatacatataatttagaacccttgtactatctgattgctaagtaattctaaatcaatagactgttttttgtttttgtgtttttttgagatggagtctcactccatcacccaggctgcaggctggagtgcagtggtgctatatctgctcactgcaacctccgcctagtaggttcaagcaattgtcctgcctcagcctcctgagcagctatgattacaggctcccaccacaatgcctggctaatttttttgtatttttagtagagatggggtttcaacacgttggccaggctggtcccaaactcctgacctcaagtgatctgcccaccttggcctcccaaagtgttgggattacaggtgtgagccagtgcacccagcctgaatgtggttttgaaatcttcaatataccaaacaaagaaatcttcaatataccaaacaaagaaatttctttctaaagtaagtttactgtaatgtagtttagccattctatggtagcccccaaaaaaggacataatggtataaaacaaataatatacgctaaaatgaattcttttacactaatttcttttagcttgaatttttggcaaggtgagtatgttggcatattccacataatgacaaataagtttagcacagaaagacatattggaagtaacttacaataacctttcagtgagttttctgagtgcttttatcagaatgattatttaactttggaaaacttacttgatttcaggcatctaacaaaggagaggaaatatatattctctgtaagaatggccctagtaaattgccttaaaactttgcttgaggtgagtttttgcatttttttagtaagatctccattgaaaattttaaagcagtctttgtttgttaatgagtaatttttctctatttcatatttaaccacagttcttttcccgtaggctgatccttattcaaaatgggccattcttaatgtaatgggaaaagactttcctgtaaatgaagtatttacacaatttcttgctgacaatcatcaccaagttcgcatgttggctgcagagtcaatcaataggtaatgggtcaaatattcatgaagtatttggaatgctgcagatggcagtagaatgtcttacatagtaacagctcacagttgcaatattaaaaatagctaacacttgttgagtatatacggtgtgcctggcatttatgtttattcttaattcttatacttctgtcacttagattctattatttccttcaatttataaatgaaaactgtgacttagtgaggtaaagtaacttgcttatgccacagagctaacaagtggttgactcgagtgaggtgtgtctactatcatgtacaggagatacggactgtttggaaattactgtgattttatgtgagtttatgaaatgataattagcacattttacattgtgctaattacaattatatttacttgagtgaacatccagtgaagcactggaaggattctatcatgaggatcttttatatttgagtactggaataaacatatattaatttcattctttttttttttttttttttttttttttgagatggagtttcgctcatgtctcccaggctggagtgcaatggtgtgatctcggttcacttcagcctctacctcctcggttcaagcaattctcctgcctcatcctcctgagtagctgggattacaggcgcctgccaccatgcccagctaatttttttatttttcgtagagatggagtttcaccatgttggccaggctggtcttgaactcctgacctcaggtgatccacccaccttgtcctcccaaagtgctgagattacaggcgtgagcctttaatcatgtagtttttgtcattcgttctgtttatgtgatggattatgtttattgatttgtgtatgctgaatcagccttgcgtcccagggatgaagctgacttgatagtggtggataagcgttttgatgtgctggattcagtttgccagtattttatcgaggattttcacatcgatgttcatcacggataatggcctgaaattttctttttcttgtgtctctgccaggttttggaatcaggatgatgctggcatcataaaatgagttagggaagagtccctctttttctattgtttggaatagtttcagaaggaatggtaccagctcctctttgtacccctggtagaattcggctgtgaatccctctggtcctgggctttttttggttggtaggctattaattactgcctcaatttcagaacttgttattggtctattcagggattcgacttcttcctgctttagttgggaggttgtatgtgtctaggaatttatcactttcttctagattttctagtttatttgcatagaggtatttatagtattctctgatggtagtttgtatttctgtgggatcagtggtattatcctctttatcattttttattgagtctatttgattcttctctctttattagtcttgctagcggtctgttttgttaatcttttcaaaaaatcagctcctggattaattgatttttttgaaaggttttttttgtgtgtgtgtgtctctatctccttcactcagctctgatcttagttatttcttgtcttctgctagcttttgaatttgtttgctcttgcttctctagttcttttaattgtgatgttagggtgttgattttagatctttcccactttgtcctgtgggcatttagtgctataaatttccctctaaacactgctttagctgtgtcccagagattctggtacattgtgtctttgttcttattggtttcaaagaacttacttatttctgccttcatttcattatttacctagtagtcattcaggagcaggttgttcagtttccatgtagttgtgtggttttgagtgagtttcttaatcctcagttctaatttgattgcactgtgatctgagagactgttacgatttccattcttttgcatttgctgaggtttgttttactttcaattatgtggtcagttttagaataagtgtgatgtggtgctgagaagaatgtatattactctgttgatttggggtggagagttctgtagatgtctgttaggtctgcttggtccagagttcggttcaagtcctgaatatccttgttaattttctgtctcattgatctgtctaatattgatggtggggtgttaaagtctcccgctattattgtgtggaagtctaagtctcttcgtaggtctaagaacttgctttatgaatctgggtgctcctgtattgggtgcatatatatttaggatagttagcacttcttgttgcattgatccttataccatcatgtaatgtccttctttgtctttcttgatctttgttggatgtttgttttatcagagactaggattgcaacccttgctttttttctttctatttgcttggtaaatattcctccacccctttattttgagcctatgtgtgtctttgcatgtgagatgggtcccctgaatacagcacactgatgggtcttgactctttatccaatttgccagtctctgtcttttaactgggacattttagcccatttacatttaaggttaatattgttatgtgtgaatttgatcctgtcattatgatgctaactggttattttgcccattagttgatgcagtttcttcatagtgtcaatggtctttacaatttggtatgtttttgcagtggctggtaccagctttgcctttccatatttagtgctaccttcaggagctcttgtaaggcaggcctggtggtgacaaaatctctcagcatttgcttgtctataaaggattttatttctcctttggttatgaagcttagtttggctggatatgaaattctgggttgaaaattattttctttaagagtgttgaatattggcccccactctcttctggcttgtaaggtttctgccgagagatctgctgttaagtctgatgggcttccctttgtgggtaacccgacctttctctctggctgcccttaacattttttcattcatttcaaccttggtgaatctgatgattatgtgtcttggggttgctcttctagaggagtatctttgtggtggtctctgtatttcctgaatttgaatgttggcctgtctcgctagattggggaagttctgataatatcctgaagggtgtttccaacttggttccattctccccatcactttcaggtacaccagacaaacgtagatttagtcttttcatatagtcccatatttcttggaggctttgtttgttccttttcattcttttttctctaatcttgtcttcatgctttatttcattaagttgatcttcaatctctgatatcctttcttctgcttaatcagttcggctgttgatacttgcgtatgcttcacgatgttctcatcctgcatttttcagctccatcaggtcatttatgttcttctctacactgattattctagttagcagttcctctaaccttttttcaaggttcttagcttccttgcattgggttagaacatgctcctttagctcagaggagtttgttattacccatcttccgaagcctacttctgtcaattcgtcaaactcattctccgtccagttttgttcccttgctggtgaagaattgtgatcctttgcagcagaagaggcattctggtttttggaattttcagcccttttgcgctggtttttcctcatcttcgtggatttatctacctttggtctttgatgttggtgacttttgtatggggtttctgtgtggacatcctttttgttgatgttgatgctattcctttttgtttgttagttttcctttttacagtcaggcccctctgctgcagatctgctggagtttgctggaggtccactccagaccctgtttgcctgggtatcatccatggaggctgcagaacagcaaagattgctgcctgttccttcctctgggaaggttcgtcccagagcggcacccgccagatggcagcgggagctcttctgtatgaggtgtctgtcgacccctgctgggaggtgtctcccagtcaggaggcacgggggtcagggacccacttgaggaggcagtctgtcccttagcagagctcgagcgctgtgctgggagatccgctattctcttcagagctggcaggcaggaacgtttaagtccgctgaagctgtgcccacaaccacccctttccccaggtgctctgtgtcagggagatgggaattttatctataagctcctgactggggctgctgcctgtctttcagagataccctgcccagagaggaggaatctagagaggcagtctggctacagtggctttgtggcactatgttgggctccacccagttcgaacttcctactggctgtgtttatactgtgaggggaaaacatcctactgaagcctcagtaattgcagacgcccctccccccaccaagcttcagtgtcccaggtcgacttcagactgttctgctggcagcgagaatttcaagccagtggatcttaacttgctggtctccatgggggtgggatccgctgagctagaccacttggctccctggcttcagccccctttctaggggagtgaatgggtccgtctcgctggcgttccaggtgccactggggtatgaaaaaacactcttgcagctagctcagtgtctgcccaaatggccgcccagctttgtgctttaaacccagggccctggtggtgtaggcacccaagggaatctcttggtctgcgggttgcaaagactgcgggaaaagcgtagtatctgggcaggaatccaccattcctcacagcatagcccctcacagcatagtccctcacggcttcccttggctaggggagggagttccccgaccccttgtgcttcccgggtgaggctacaccccaccctgctttgactctccctccgtgggctgcacccactgtctaaccagtcccaatgagatgagccatctacctcagttggaaatgcagaaatcaccaccttctgcgttgatctcactgggagctgcagaccagaactgttcctatgttgccatcttgctgttcccttgttttatttttctctagtatttatgataacgtgaaacatattttaatatatttacttctccgtattccactagtatatatgttcctaaaggcactggtttttgtctgttctgttcattgttgtatttttagcacctaaaacaatacttggcatgtgataggtatccaataactgttttaaaataaatgaatgtacttgaaaaaaaattacatgatgcttcaaaaacatcaaagctgaaaatcatttgagtaactttaaaatgtaagcaatcaataataaaagattactatattgttcagcagtcacataaagtattaaaactaatatttcagtatttgaatatgccgacagtaatgttttcataaactagattttgtgtctaactcctcaggtttggaactgtttttagtaagaccataatgcattgcaaggatttctaatgaatatgtttagtagttcaagcccttattaaatttcacagataaaagcaaatgtatgctgaactttaaggactgaggtaatataagactgaattgaatgtaataaggcggcagtgtagtggtggcattaaaaaaactgaagattcaaaaagtataaattcaagaataacatgcaagtagcattcttttttttaattttacacttgttagattttgtcttagtccctttgtgttgctataaaggaatacctgaggctggatatttacaaagaaaagaggtttatttggcatatggcgtctacatctggtaagggcctcagactcatggcagaaggcaaagaggaatcagtgtgtgcagagatcacatggtgagagaggaagcaagggtggaggcggggaaggccatgccaggctcttttttttaataaccagcccttgtgggaactgaatagtgagaactcactcattccttaccctcaggccttaatctattcgtgagggatctgcccccatgactccgacacctcccattaggcataacctaatggggatcagatttcaacatgacatttggaggggttaaacattcagacaatagcagatatctaatgttcagctattttaagagcagtgagtgaaactagaagaatcagaggaacataaacaattataaaagcttcgattactaaaaaaggataaaagacaaagttgattaaagagttatccttaaatatgtgggtgttacgcaaaaggtgtactgatcaacttttttccatcacataaaacaaaatttaaatggtacataaaaacattaacttacccgctttcagagtgattaaatgttagagcaggttgacattggaatctgtggactcaactaattggtgttcggccagagaacagtttatcttttctggctagtttgagttcagtgctgttcaaatttgagcaatagttaaaatatattttgagaccctcttcagttctaggagaaaatagattttgtattcaagaccttaatactaagctgctggtctgaacctctttaaataaactcaggttttgttagtctttaagaaagagctagtatgttattatgtctcacagagtgatttatttttgttctggaatatgctttggaaagtagggtttgaaattagaaaattatttcactttttgtttgtttgtttgcttgcttgttttaagattgttccaggacacgaagggagattcttccaggttactgaaagcacttcctttgaagcttcagcaaacagcttttgaaaatgcatacttgaaagctcaggaaggaatgagagaaatggtaattttaagtaacatgtatttgctgttatcatatgcttgctatgaatatcccataaattacttcaccaagtttggtataagagagtttataatccagtagtttacagtataaagctgctctaaaacaactgtatgaattgattgaaactgcattctttctgggtcacaatgggtcaaatcatagcaatttcttttggtttagcatttttatggagaaacccaaaatttaactgagtttttatgggagtataaatggctcccttttttattttaaaaatccttttatatgtgatctgattaaaagctaattaagggaacaggtgacaatgggaagaaatggattgaggagaagaatctcacacaaaatcaaatcattgtggtgtttacagtgaaacttgtgatatttcacgtttctgtagaataatatattttttatggtaatgattatcttagagttcaaattttttcatttatttatgccctggtttgtttcttacaagtatttaaggtagttaaataactgtcaagtctgtgatagcaggaaattgaaaggaacaattgaaagaatgtgagtttagaaaagaatttcaatagattagaaagataagtgtaaataacataaaatctaatgagataatgtatattatacattttaaatcagcctgtcatctgcaaaaagggaaaatactgatctgacagcaattcatttagaaaaagacctaggaagttttgtatcttgtgattatagtatgaatcaacattgtattacagttaccaaaaaggctaactctgtcttacactgcattaatagaagcatattgtcatgaacaaagttaatacaagaacttggatcttttatactttttgctttatttttagatcttttaatttttatgggtacatagtaggggtgtgtgtgtgtgtgtgatacgggtatacaatgtgaaataatcacatcatggagaatggggtatccatcccccaaacaaatatcctttgtgttacaagcaatccaattacactgttttagttattaaatgtttctgtattttttagaggataactataatgtttggtttggttctgagtaaagtaaaagatttttagccagaatgttatagatctgtgtcttataaaaaatggatgaaggaattgacttagtggaaagctcacatttgtttttaaacatgtcagtgcttgtgatttagcaaaggtattggtccttactctttcttgtaccaaaagacagaactaggattagtgagtaggaggtttctgaaatgtgtatagcttgtcaaaaaatctggagttcagttgggattttataattgattgttaaacatttacattttacattacattttttttttaatttctttttaagtcccatagtgctgagaaccctgaaactttggatgaaatttataatagaaaatctgttttactgacgttgatagctgtggttttatcctgtagccctatctgcgaaaaacaggctttgtttgccctgtgtaaatctgtgaaagagaatggattagaacctcaccttgtgaaaaaggtatatatggatgagtattttattagaagcttccttaggtcactgtgaaataatttaaaaagttaaagctagattttctgagtggcacttatttaagactaggaaacaattttattttttaggttgggaatattggaaagcagttatacaaaaactattcaaatggtatatttatggtatgcactgtttcttacattccatttaagagcatttcacaaggctttcattgtactaacaagagtgaatgacttgtccaccagactgaccaggcttttggaaatagtatttattgagggaaacacatggagacaagagcagcataggtgttttgcccggtagattctggggcagcacattgggatccagcagggccagaagtcaaattttagagctatcaggcttttaagttcagttatcaggggagaaggactagggtccaagccttataattactacatcagcacagtattatagaatgttggccccgtctcttttccatcacctcagcatttatggtttaggaagttccagacctttccattgcaaatttttatgtgataaatcagtggtaggtcagtggactgatattatgccagttaacattctaccagcatagtttccatggtgctttggagtaagccagcctataatcagttagccttttacctctcagtataagacttgttcggtgtttcttaaaagtatacaaatacattacctaataatcataagtgttatgtattgtttggatttttcttatttggatttaagcctaagagaaataattttactttatatttatttatttattttgaaagacagggtctcactctgtcacccaagctggagtgcggtgatgtgatcatggctcactgcagtcttgacctcctgggctcaagcgatcctcccaagcctcctgagtagctgggactacaggcatgtgccaccacacctggctaatttttttttttttttttgagacggagtctcgctctgtcgcccagactggagtgcagtggcatgatctcggctcactgcaagctccgcctcctgggttcatgccattctcctgcctcagcctcccgagtagctgggactacaggcgcccgtcgtcacatccacacacctggctaatttattatacagacgggctcttgctatgttgcccaagctggtcttgaactcttgggcttaagcaaccctccctcctcagactcccaaagcgttgggattacaggtgtgaaccaccactggccagtaattttacattaaatcttcctttaagtataaccaaatgttggaaactcttagcatatttttatatttttatttacttaacatttattaagggtttgctatgtgtcagatactgtgccagttgagtacattttcttaattattattcccatctcatagatgaggaaatcaagaaaagttgaatgaatgttgtttctaggtcctactctaaataatattaacaagcatttaaatgatttatttttttcatttttcttaacacattgactttttggttcgtgcaggttttagagaaagtttctgaaacttttggatatagacgtttagaagactttatggcatctcatttagattatctggttttggaatggctaaatcttcaagatactgaatacaacttatcttcttttccttttattttattaaactacacaaatattgaggatttctataggtaagtttatacatgacatatgtgaaatttgtttaatttaaaattagttaacaatacttagcaagtcccctcaccagcaacacacataccatacccatacacatgtgtgtgtgggagcctacatagtatgagaagcaggacagcttcttttaataagaatgtattgaagggagtcactggacttcagatctggtcctagctgtgccaacaaccagctatctgactttggtcaaaccacataaagaccctctatgccttggttttttaatatgtaaagtaagcaagttacacaaggagatctttcaggtccttttcagctttaatatttgatcatctttcctttggaaaaaattgaagataaattactagtagctggttatttctgccttgtttttcttttctgttgcttgactataggcctcttagttattacttctattagatttagaaacttaatgtaaaactttattttgctaactttaactctgtagaagaaaaatttgaaaatggagaggtttgaaacaactaaaaagtaatgtttaggtatcaggatgatgggaaggcatctcatatttgttgaacatgctctgtgttatggactttgctatgcattttacatgtagtgtatcacagatctgagtttcagacttatcctaatagagttttctaatagattatgagttgtatgtaggtagtttcctttaagaaggatattcctacaaaagtaaatttagtggtccttatagttcattcattttggcaagaacaatatagctatatctctgtatatgcgagggattcattccaggatcccccatgtatgcctaaatttacgcgtactcaagtcaccaagttggccctgcagaacccacgtatatgaaaagtcagtcctctgtatatacagactttcacatcctgtgaatactgtttttctatctgcatttggttgaaaaatatgcaagtataagttcaaacccatgtttttcaagggtcaactgcatttatgttagttgattatgcagaagaaataaatataaattcaagtctccatttttatttgtttattgttttgttttttctttttgctaagggtgctactgaacaaggtcccatttttaaatcccataattatggtggtggtatgttctaagctttctaatttttttaatgtgactatttagaatttacttaatttttccatttataaaattaaagaatgtttaataatctggataaagtatgatactttaatgctgatggtattaaaacagtttttaagaactattttataaaattttacttggaaaagttatatataacctgtattttaaatttttctatttttagatcttgttataaggttttgattccacatctggtgattagaagtcattttgatgaggtgaagtccattgctaatcagattcaagaggactggaaaagtcttctaacagactgctttccaaagattcttgtaaatattcttccttattttgcctatgagggtaccagagacagtgggatggcacagcaaagagagactgctaccaaggtctatgatatgcttaaaagtgaaaacttattgggaaaacaggtatggcttcaatttttatgtacttttcattccctgaatgatatgagatataacctttaagttttaaggctatttattcgatttattcgtatttatatattgaaacttagcttgtggtaatcattatctagcatagccaacccatgaatttttttggttatgtcgtgttgtctccctctgattggcttttaactaagtagaaatgttttaaattagaaataatccaaaaaaccatttgaataattttcttctgccatttaaaaatttattttaactgttgtaatacacgaatgcaaactggttgttaaagtcaaggaatactaaacagtgtacagaaaaccttcactccctcttcaatctcaccaagctttccacttttcaagaaaaacaaccgtccctcattcctatagttctcataccctgctgtttgtttttttgtgacacttattaccttctaatgtatgatacaatttaccttttttttctgtctttgcttttgtttttgagacagagtcttactcttttgccaagactggagtgcagtggcatgatctcagttcactgaagcctctgtctcctgggttcaagcaattctcctgcctcagccacccaagtagctgggactacagctgcgcaccaccacacccagctaattttcatatttttagtagagacggggtttcaccatgttggccaggctggtctttaactcttgacctcaggtgatcttcccacctcagcctcccaaagtgctgggattacagatgtaagccaccttgccagaccataatttacttttgaattatgtttattatttaccagtcttctccagtatacatttttctctctttttttttttttggctgatgtatctctaatatattttgagtattcattaaatgtttgtcaaaagaaggagtcaagtaaggaaggatttaaaaagcttcgtttgttttataatcatttatatacatttccaaaattttttgaagcaacttatattaaaacatacatacaaattttttaagataaaaaagctgtggtcaccccacatttatgtatgtatttatttattttggatataagtaagggataagtaaccaaacttggtcaatattagataaacttcaagggaccttttttttttttagtttcctagttatctatattgaaccaagaaatggaacagcaagttccttagttgcttaggtggacctattcagaactggttgtaagtctgcagtctgaagggaaatggtgagcagaggactcctttcccaaagacagctggaacagaaataggcactccagaggttatggaatttgagagagatactcagcctctagccactcccattcaatctcccagcttagtcttctgagcattcttaatcttactattcttttcttaatgtattcaaaccaaaagacagcaatttttagagcctgaataggttttggagggaaaagtaattacgttcaacttcgattgaaactcttgcctcaagaatgaagaacagcaaaaattaaatcacagtttcttagctttttggttaaagatgtaagttaaattcttggccgggtgcggtggctaacgcctgtaatcccagcactttgggaggccaaggcgggtggatcacctgagatcaggagttcaagaccaacctggccaacatggtgaaaccccatctctactgggtgtggtggtgtgtgcctgtaatcccagctgtttgggaagctgagtcaggagaatcacttgaacccgggaggtggaggttgcagtgagccaagattgtaccactgcattccagcctgggcaacagagcaagatttcgtctcaaaaaaaaaaaaaaaaaaaaaaaaaagaattgtataaaacacacaaacaaagcaaggaaagaatgaagcaacaaagccagagatttactgaaaatgaaattatactccacagagtgggagtgggccctgagcaagtggctcaagggcctggttacagaattttctggggtttaaatacccttcagaggttttccattggttacttggtatacaccctatgtaaatgaagtagtggtctgtaatcagtctgattggttataggaggggaccaatcagaggtactttcaatttcttatctgccacagtaaaagggagggggttgcaaagggagtagcctcttgtccttttgttacttgagcatggaaagttggggttttccttttgatttcgttctaggaggtcagcatggattgaccttaggttccctgcctccagaccttattgccctgcctcatttacgttaggtttctttcttgtcaccttctaaaatattttttgttattaggaagtatgtttttgaacttccttatgcattaagtaaattagccatttatcactgtaattccttatttggaaagttgttatattcacccttaagacttcacaattctcattcatttaactaaagtgcaacatagcagacttattctttatatttagagaatttgtgtcttttgtgaagctacctgtctatagtgggaagtagattaatgaaaagtccaaatctgttggggagggttttattctactattgatgaaaggggatgtggatcgcagctagccttagaatttgggatggcactcaagtagaagtctgggaagaagttacgcagggaacaaagatgacattgttcgcagtccctgggaattcttaacagtaaagttctgtaattgagacagaattcccaaataaagtcaagagtaaaattcagatagaggagcagttatacatcagtgggaaatttggttggcagaaaaattaccaggtcatacaacttaatgatagacctgaagtcttatttaaaatgattctctaaaattgaagaattggattaagggggccttgtttggctgattttcatactttttcctcttagtctacaggttggctgcatagaagaaaaaggtagagttatttataatcttgtaaatcttggactttgagtcatctattttcttttacagtcatcgaatacttttggaaataaggtaatatatgccttttgagctgtcttgacgttcacagatataaaatattaaatatattttaattttgtgcccttgcagattgatcacttattcattagtaatttaccagagattgtggtggagttattgatgacgttacatgagccagcaaattctagtgccagtcagagcactgacctctgtgacttttcagggtatgtacattttaaacttagagaactagctctaacttcacaagtttttaaagaagtttattggttgacaccttcaatgtctatttcaatttatagacatcactctttttaaaaaattttctttaaaaatagccacctttgaattgaggtaattacctatcctcttttaccatagtctccccacagtaattactctttctaaattgaccacttggttggccaacccaataaccttttcttagtctttctgtaatatttgaacattgtgccatctgttggcccttgaaatttttttcttcatacacattattcctagttctcttctctttatctaggtcttgcctttctagatcaccttttctttttttttttgagatggagtctcactctgttgccctggctggagtgcagtggcataatctcggctcactgcaacctctgtcttccaggctcaagctatccttccttccacctcagcctctcgagtagctgggacgacagatgcacatcactgcgcctggctaattttttatatttttggtagagacggggtttcactgtgttgcccaggctggtcttgaacttctggcctcgaatgattcccccgtgttggccaaccaaagtgctgggtctacaggcatgagccgccgtacccagcctcaccttttctttattgtgcgttattatctgtacaatttaatttggatgtgaatgtctctgagttgtatatgaacatcagagttgtttccctggcttgattgtaagctacttgaaaatatgctttacttttttttttttttttttaatgtgccctactgtgctgggcatataaaatagtaataatatctgagaaagtactttcacatatgtaatttcatgctgtctaaataagtgttgattgccatgtcttaaagtactgcttttacagtactggcatagagctttgattctgatctgaagtaatactgaggctcatttattgaactgccttttaactttataagattttttaagaaaatcattataagatcatttaagattatttaagttactgagggtgaaaggtatttagataatctgatttatatatctggactgtgatatgtcatttgtgattttattgaaagtatagtttttcagtagaaaaatggtttttgaatttgggggttattaaaatctaaattttcattttggaagttcactggtctatgaacaaaactttttaaaacgatgactgtattttttcccttaactctgttagggatttggatcctgctcctaatccacctcattttccatcgcatgtgattaaagcaacatttgcctatatcagcaattgtcataaaaccaagttaaaaagcattttagaaattctttccaaaagccctgtaagtatacatgatgagtttaataatagaacattccttcttttttagctaaaaaaactttgtaaatacatcttaaagaggaaaagtaaacaaatgaaaaatttatctcataattaaaaaggaaaacattcatttacaagtttaaatggtattttacttgtcagcattaattgaaatatgttacatatgagaacagaatcttgtgacactttagtgatatattagctcagggaatatatctactttttcataggaatatactatttaattgtagtttactttctgaaaattaaataaattggcaatagtttaagatagtaattttcttaatgtaacattttgtacttgatatcaaacccaaatctaaattctgttatttagttattttaaatataaaatgtgtaggtattcaaatatttgaagaaaaaatataaagtgtatttattgtagccgagtatctaattaaacaagtttttactaaatctgtttattttctaggattcctatcagaaaattcttcttgccatatgtgagcaagcagctgaaacaaataatgtttataagaagcacagaattcttaaaatatatcacctgtttgttagtttattactgaaagatataaaaagtggcttaggaggagcttgggcctttgttcttcgagacgttatttatactttgattcactatatcaaccaaaggtaaataacatatttagaccaatatataagcagtctttctatcctgttcttcctgtttttttgctttgttttgttttgttttgagacaaagactcactctgtccgcccaggctgggtgcagtcacggctcactgcatcctcaacctcctgggttcagattatccttcctcctcaccctgccgggtagctggggctacaggagcataccaccatgcctgactaattttttgtgttttttgtagaggtggggtttcaccatattgcccagggtggtctcaaactcctgggctcaagcgaactgtcagcctcagcctcccagtgtgctgggattacaggcatgagctactatgcccaacctatcctgttcttttaattgaaagtttatatgcttctaagaggtagataccagaatgttgctttctgaattttgctttttaagatgtctattatatttacttattagtttttaaaaattgcgctacttgcctgggaaacatagcagacctcgtttctactaaaaattttttaaaaaagaaaattagggcaaggtgtggtagctcacacctataatcccagcactttgggaggttgaggtaggtagattgcttgagcccaggagttagagaccagcctgggcaacatgatgtgaaaacccatctctacaaaaattttttaaaaaataagccagggattgtggcatgcacctgtagtctcacctactccagaggctgaggtgggaggatggcttgcgctcaggaggcagaggttacaggttacagtgagcaaagattgtgccactacactccagcctgggagacagagcgagactcttgtctcaaaaaaaaaaaaaaaaaaaaaaaaaaaaagaaaattatccaagtatgatgatatgcgcctgtagttctagctacttaggaggctgaggtaggaggatggcttgagctcaagagtttgaggctgccagtgagccttgattgcaccactgcattcatgcctgggcaacagagtgagactttcactcaattaaaaaaaaaaaaaaaagcactacttctccaattctagaaatcttaagaaggatcttcaacattttaatactaatattctagctattgatggcctcaaataaatgttactatagaattggggttgttcggccgggtgtagtggctcacgcctgtaatcccagcactttgggaggctgaggcgggtggatcacaaggtcaggagatcgagaccatcctggctaacacagtgaaaccccgtgtctactaaaaatacaaaaaaattagccaggtgtggtggcaggtgcctgtagtcccagctactcaggaggctgaggcaggaaaatggccagaaccaggtaggcagatcttgcagtgagtctaattcgcaccactgcactccagcctgggcgacagagcaagactccgtctcaagaaaagaaagaaaaaacaaaaacaaaacaagaattggggttgttcaatttagcatctctgatcttttccattgattttaatgagatttctattttttaaggtcttttttattgtggtaaactatataacataaaattttttattttcgccattaaatggccagttcagtagcatcaattacatttccattgttgtgcaaccatcaccactgtctatgtccaaactttcattatctcaaactgaacctctctactcattccacaataactccacattcctcctccccactggccattgagaaactaatctattttctgtctcaatgaatttgcctattgtagatattttaatctagagttgtacaatatatgtccttttgtgtcttgccttgtgtggtcactgaaaactttgtaccttagcttgtgtttagatagtgtttgatagagatttccttggataccaagagtgttgggatgaggaagcatgagaggagaaaacttttcctagtgtttgcagattggctttatgctaggattcttcttcaacacttagccatgcttgcattgcttgggatcagccccaaatacaagcttagggtcttctctggtcttttctgagcaagagtcttatcttgagcatgtgtgtggctttctgaattccccctaatttgtgggtgcttttgaatatactaatttcccaaagaaatacgctccccagctactcctaggctttaggcagcctcttgtatgtctcaacagtaatcttttgccctatgcacctgcaggttgttggtctgccttacaaagtttcaagcaacacccatatcttttgtagctggtatgaagttaaacaaaacagagctacgcactttacatcagtccttggttccagacaggttagaatagacatatacaatagtttgcaactaatctacttagctccatgaactaccatgagccagtgtctcacaccgaggatataggccactgcttttgtgattgttgccacgctggggtaggggtgggcaaggacaagtaaagttaccacaaagctttcctgctgtttttcagttggatttttcttgattcaatattttcctgattactgtaaacctttgactattttacagaattctaacaaaattagttctgacaattttgcctgtttttcaatgtttctattaaaggatggaagcttagagctgcctattctgcattttgctgatgtgacttctctttttggcttataagccattaaaatatttatgtcaaggcatataagaattagagatgctgaacaaaaggacttctgaatgaatttatttcagagtaattttccagaacttactggttgttgttgtttttttttctccctatattaggccttcttgtatcatggatgtgtcattacgtagcttctccctttgttgtgacttattaagtcaggtttgccagacagccgtgacttactgtaaggatgctctagaaaaccatcttcatgttattgttggtacacttataccccttgtgtatgagcaggtggaggttcagaaacaggtaattttctgactcatcttcaaaatggtatttaaaatatataaagtattgttagaaggatttgagtgttttatgtttatttggtataattggtgattttattgagaatattttttgtaaaatgattggaaaaatattcttaatgaattaacctttgtaatcaattacagagcacttggtacttttgatagttttatctactgtgctgaagtagagaggtagtcaaaactagggatagcagttcgcaacgttatggtggtatttgagttactacttatataaactgtttcattaatattggcattttttttaacctcagtacccatcttgtagtagtaccttacatagttattgaattatttgaaaacacagaaactaaaagctgggtatcttagacgtaattagaacatttaatctgatctaggttaatagattttatcatttattacagtaagttttgttggcttactttaaaattatttctctccttataattttttctttttaaattatatttaggtattggacttgttgaaatacttagtgatagataacaaggataatgaaaacctctatatcacgattaagcttttagatccttttcctgaccatgttgtttttaaggatttgcgtattactcagcaaaaaatcaaatacagtagaggacccttttcactcttggaggtaataaaaatttcatcatctactattttttattagagaacatagtagtacttttcaaaaatctgtaatgctctagcagtaaaaaatggaatcttttctttaattgtgattaaaaatatatacgtaggccaggcacattggctcatgcctataatctcagcactttgggaggctgaggcaggaggattgcctgagcccaggagttcaagaccagcctgggcaacatggcgaaaccccgtctctacaaaaaattagtcgggcatggtgatatgtgcttgtagaatcagctactcaggtagctgagatggaaggatcacctgagccctggaggtcaaggctgcaataagccaagattgctccactgcattccagcctggatgacagagtgagaccctgtctcaaaaaaaaaaaaaaaaaatatatatatatatatatatatatatgtgtgtgtatataaacacatacttgtgtgtgtgtaacgtgagatctacctacttaagaaataaaaaaatgaatcttaatgtatctctttgcattgaagccaaagtataaataacaaaacttcctggtaaagatccaaattgtaagttttcaaggaatgtgatgtaaaatagttttgattttaacacataagatcctaaggtccactgatagctcaaaactaccaatggatcttttcaatgtcaatttaatgtttgtgttagagataacgtttaacttttgaaagcatattttaagttttaatctttataaacctcgaaattatgtttaggtatattcttccatacatatcttaattataatttttaaatgatagtctgtatttgactctatgtaaatataaaaacatatttaagtatgttaagatgtaaagttatactactaaagagaaatttaagcatttccttccagttgagtatgctataacaatcttgaagtctgtgttaccatgagagagtctattagaatttaaaggattaggctgggtgcagtggctcacgcctgtaatcccagtgctttggaaggctaaggcgggcagatcatctgaggtcaggagttcgagaccagcctggccaacatggcaaaaccccatctctactaaaaatacaaaattagctgggcgtggtggcacattcctgtaaatgccaccttttcaggaggctgagacattagaatcacttgaaccggggaggcggaggtagcagtgagccttgatagcgccactgcactctagccttggtgacagagcgagactctgtctaaaaaagagtattaaaacattgtagggtttgcagtggaagaaatcatttatttcttccttgattagtagtaatagagacatgagtcagtgtctataaatggcacttaactaatttttttcttttattaagttttatttcacaggcttaaccaatacgtgttaaaagcaagttacattttctcttttaggaaattaaccattttctctcagtaagtgtttatgatgcacttccattgacaagacttgaaggactaaaggatcttcgaagacaactggaactacataaagatcagatggtggacattatgagagcttctcagggtgctaattttaaatgacatgggctatttctacctgtttctttttgaaagaatattttgcaaagtcttgctcttggtttcattgtcacagacttagttcagactctcatcatttagttcagaccctcatttctcatctaactgtaaaactggtcctaactggtcttctcaccctgaactcttcctgttttattcatcctctgccagatgatttctctaaacccaaatatgatcatgtttttctactgcctaaattttttttttaagagacagagtttttttttttttttaagagtctcactctgtcacctaggctggagtgtagtggcaccatcataacttactatgaccttgaattcctgggtacaaggaattctcctgtctcagccttctgaatagctggaacaacaggcacacaccactacacctagctactttatttattttttttattttttgtagggacaggggtcccactatgttgcctaggttggtctcgaattcttggcctcaagtgatcctcctgccttagcctcacaaagcattgggattagaggtgtgagccacggcatctagccatgcttaaacatttttcatttctttttctttttttttaagacggagtttcgctcttgttgcccaggctggaatgcagtggcactatcttagctcactgcaacctccacctcctgagctcagattctcgtgcctcagccttcctagtagctaggattacaggcacctgccaccatgcctggctaattttttgtattttttttagtagagacggggtttcaccatgttggccagggtggtctcaaactcctgagctcaggcaatccgcccacctcagcctcccaaagtgctgggattacaggcatgagccaccgcggctggcccatgcttaaacatttttaacaccttccaaccatgtaaaagaaaattttaattccttagagccagacatacaagttagtcttgtcttctagtccagtttacctgaatgaaagaaatatgtctcattttaatactttagtcatatgtgttatgtgtgtctatatatatgtaagtatgtatttgtaagtttttctagcttgcttgttaatttgatttgaaatgtacattattacagtatttgggaaactttctactttgtgttttgattttcatcttcctataccaattaatttcatatttcttttttttttttgaaacgaagtctcactctgtcgcccaggttggagtgcagtggcacagtctcagctcactgcaacctccacctcctgggttcaagtgattctcctgccccagcctcccaaggagcagggattacaggtgtgtgccaccatgcccagctaattttttgtatctttagtagagacggggtttcaccatgttgtccaggctggtcttgaactcctgacctcaagtgatccatctgcctcggcctcccaaagtgctgggattacaggcgtgagccaccacgcctggcctaatttcatatttctcttgtgttgtttttactctcagtactttttaaaatgaattttagttttgactatctgagcatagagtttctaatacatttgagatatataaaatgtatgtaaatagaaacaccattatttcttgtacttgtgttcttgagtattttatgggctagagatctgccttgtgcattacagccactagccatttggctatttaaatgaagtaaaattaaatgaaatttgaagttcagttttttcattggtactgaacacatatcaagttctcagtagtacatttggtcagtagtgatcattggacagtgtagattatagacatttccatcattgcagaaagttctgtgggacagtgctggtctaaactctaaatgttagatgttaaaaagccaagcaggctcccaaagtcccttctagctttagtgttgaatgattcttgtgcttctgtttgtgattttgctaaggtgttgacttatctgcacaatttgtttaagacattttattttctctgttgtcacatattgctaatcactttcaaaagaatctgttgtattaaggaagttcagattcattccctacatattttttgagctactcatgacttaaaaccttttttaaactttatagaagttttctagtcagataatttaatatatatgcaattataaacaaaagtgttgtcttcatgctagtttaaactaatttttaaaaaattatttctagataatccgcaagatgggattatggtgaaactagttgtcaatttgttgcagttatccaagatggcaataaaccacactggtgaaaaagaagttctaggtaaactacagtcatgcgctgcgtgacatttcagtcaactgcggatcacatataggacagattataatactgtatttttactgtatgttttctgttgcctgtagtattcagtatagtaacatgctatacaggtttgtagcctaggtgtgtagtaggctataccatctaggtttgtgtaagtatattctgtgatgttcacgcaatgacagaattgcccaatgacacatttctcagaacatatctgtgtcattaagcaaagcatgattgtattggcggaatgaatgtgagttatgcggtggtcatctttattatatgagtggttatctttattatatcttcaaaataagtgagggtttgtcatttgggatattggggaaatatgagatgctagctaagttacatgcctatttaattaaaatgtccctaaaaaggccccttttgtacttttcttccttaaatattcatataaaatgaaaagttagagatttacatatgtgtataacttaatttgaaaatgccttgtaaatatttaggaaagtcagaaatacttgtttttagagttaagttgcaaataaattgactgccgatatattttataaatacattataactgacaggtactcagtgtcttttgttatgtagcagacataagaatgaagacttggagggctagattaaacttaaataattaaaaaccattcaagtcctttcctacagccatttgaggggaaacctaatgtaaaataagaagccaacatcatctctagtttaggtgtttagatttagtgaccacgggatggagaaatcacctggttaaagtcagcttgaagctctcgtgatggtttttgtttctaattagaaaaataggaataagtagtgtttcacagattctactatctttcttcaacagccttaacttctcattaggagcctaatatctacagtacttccttttttgtagattttaaaaaattgagatatatcctaatatagaaaagtatacagatcaaaaatatctagcttgaagaatgtttgcagagtacgcttgtacatgtagcacccagactaaaaaacagaatcttaccagaactgtagaagttttctttaaccaacatacttacctccttgtccatagtggcactgcttttatggacagacctgatttacaacagaagccctaagtggctttcctgtgtagcataaaattaatgtggtttgttctcacagctttccccctaagatcaggaatgagacaaggctgtccactttcactactgctgttcaacagtgtactggaagttctagccagagcaattaaacaagaaaaagaaattaaaagcatgccaattagaaaggaagtaaaactatctgtatttacagacgacatgatcttatgtatggaaaatcccagagaatccacaagaaagctactgtagtgctaataaatgaatttagcaaagttgcagggtacaagatcaacacataattagtggtgtttgtatatactagcagtgcacaatccagaaagaattagaaaagcaattccatttacgatagcatctaaaagaaataaatagccaggaataaatttaatcaaagaggtgaaaaacttatatacattctgtttgttagacgtgagtcactaagtacagaccacactcaacgggagggaagttaggctctaccctttgaaagaagggctctcaaaaaatttgtgaacatattttagtaaataccatcatgatggaaagagcacgaagagccctctgggttgctgaaaatgtcctgtcttcatctggttagggagaacacaggcagaaaaaaatgtgtatttgtatgtataaattttcattgaactgtgtgtttaagattatggaatttgtgtgatacctcaacaaaaattttaacagttttaaggttgattctctctctctttttttttttttcttttgtcacccaggctagagtgcagtggtgccatcttggctcactgcagcctccgcctcctgggttcaagtgattctcctgcctcagcctcctgagtagctgggattacgggcctgcgccaccacgcctggctaattttgtatttttagtaaagatggggctttaccatgttggccaggctggtctcgaactcctgacctcaggtgatccgcccgcctctgtctcccaaagtgctgggattacagtcgtgagccaccgcactcggccttaaggttaattcttgaagtacagaaaaacagcattatagttttgaaattagaaaatttcagttttatgtatgatctcttacctatgactctactgaaatagaatttctatatgtagaggctgttggaagctgcttgggagaagtgggtcctatagatttctctaccatagctatacaacatagtaaagatgcatcttataccaaggcccttaagttatttgaagataaagaacttcagtggaccttcataatgctgacctacctgaataacacactggtagaagattggtgagtatttattgataccttatatgtaatctcaatatgacattcatggagaatgatacttcacacaaatagatattctcagtaactaaagctttgtccttttttaaatctcagtgtctttatgaaaattcttatatttttattaattcacataattatttaccctactatgtgccagacacttgatataatggtgaacattccagacaaggtccctgttaaaattttagtgggactagacaaataaacgataaataagaaaaatgccagatggttctacacagaaaattaagataggggaatataaagggagatgttttaggctcttgtcagtatcagaggtgccactctcctctaagcgaggccttattttgatccttttaaaataagtcgtaaagcagagaggttgttttataatcctagaagtcttaagctaatcagacagggtcttctattacttattctctgtgcaaagcagaattgcaccacatatcaaaatttcaactggttggttgagattacttttgcgtgcatgctctttctctctcttatttatttgttgattgattgattggtatctttgagtactccatcaccaccatatttgatggtagcctcaaagggttttcctcacaaccaggcacctttctaagataaatacgtgttttgatttttttctgtacttcccttcctccttctcttgaggaataaatgattggcaataatgtctaactgccatgtttccgttattgatttaatgtacctgtatatttctttcttttgttgttgtttttgtttcattaaacaaatttgtatggtttctttccaaacattttattataaaaagtttcaaacatacagcacaatggaaataattttatagtaaacacccatatgcttatcatatagtatctatattttatgctgtccttgcttaatcacttctagccatccgtctatccttgtgttaacatgtattaattcatctctctcttttttttttttttttttttttgagacagggtctcgctctatcacccaggctggagcgcagtggcatgataatacatcatagatcatagctgactgtaaccccaaattcttgggctcaagcagtcctcctgcctcagcctcctaatgtgcaaagtttatgtgcttgagccacaccacactcagccagttcatctcattttttaaatgtatatcaaggtatatcaagcacagtttttgaagagagtgccacagaaaatttgcgagcattaaatgtttcattcatttcatagtaattcgaaattggtttttctgaaacagatgcacagaaatattagtgtgacttcaacttaagaatactaggaagcaggtacaagttttttgtatttttctttaacagggaaaaactttagatcttcaagggactttagcatatgaagatgtggacaaaaggattcccagaatttttattacttatatgtattagaacatattattttcaagtatttcttgagtctttttaatttatagtagtcacaattaaactgtattgaatgaagggaattgcagttgcagtgattagtaattcaagtttactgaatgactagtgaaagtcctttgatacttttatttgatattggagaattttgtaaatgtaaagtttcctaatacaaattttaaattttagttttgaaattttttcagtggaggttaacattcatcaagattaataactggtgtacttgataggcatttgaattgtttttttcagtgtcaaagttcgatcagcagctgttacctgtttgaaaaacattttagccacaaagactggacatagtttctgggagatttataagatgacaacagatccaatgctggcctatctacagccttttagaacatcaagaaaaaaggtctcttaagtaataaatgtttattgaatacccagcatatctaaaacagttctgtttgctgtgggtcatgactgttaaattgcttgaaatagtattgtactaactattaacctttcctataagtaatttaagccatatttcataaatccagggaatgtgttatttttaatttattatggcagtgtggaaaagctcagataggtaacctgaggaaatagtagttgatttttgggggaggggaaattcttaaagacagaccttgtttttttagaaatagaaagcgctactttgctcccatgaaagctgttagctctgggtatggtttatagttattgtgatccacaagtgtttatttccatgtcaagttaacatatcacaatcccctggtgaaatataggaagacccatagatttctccctttttccatgttgatatcgtaataaggttccactgtaagtattctgtgaagcatgtttaagaacacttgttccttccttagtctaagcattcctctttactatcttcttttcataaagtgactgagaaatacacagtttagttttcaccaatttaatttcagggcagaaacccaacattgaagcagtactttcagtgcatcataaatataattttagtgttagtaaaattactggtaatataaactgttaatgaaactaataatataacctggaaggcattataattctaacattttaaaatctcatttcattttgaaatcaagtctctgtggtagatgtggtctagttttgttcaagagacagatgagtcagagtttgtgatttgtgtaatatgctactaatgagtgacagagctgagagtagaacctaatttttctgctgcctaaagcagcagtttttgccataccactctgcctcttgtataaacataaatgttttcatcttaaaaggtaaacattgcctccagatttagttttaactgtatttagctttattcagaaagatttgttatactcattttgtgtaggaaaggtacaatgatttccacttctcttatttacattttctaatccctttctttctagtttttagaagtacccagatttgacaaagaaaacccttttgaaggcctggatgatataaatctgtggattcctctaagtgaaaatcatgacatttggataaagacactgacttgtgcttttttggacagtggaggcacaaaatgtgaaattcttcaattattaaagccaatgtgtgaagtaagaagattaattagtctgatataattccttgtttatgacctgtttatctaaagagtgctgtgatactgcacatcatcttcacataatatcacccccactcaaactgttgtaaatttattaaagtgagcatccgtatttagtcataactttatgcattaggtttcagcttcgggatagcaacatactagaggagttctaaggggtgccttgaataatttgttactaatgatagttaaaatactgctgattataaattatttgcattaaccaagagcctgttctaactttgtttacgtcttctgataagagcacctttattttccctgatatgctttcttgaataagaaaaaggagtggggcagcaatcagcatagcttttttatttttgaggatatagtacaatttatctcaacgaagagtaaaggtacataccaaatgaaacaaagtttgtactcttccatcaaatgtgtaatctaaaacagcatactatgatgctctaagatttacagagttaatttatagcactgtcaaatgtgattcaacagaaatgtgaaaatacaacatctgatgaggtcaaacatctgctgattacagataactgatagagaagtattttcgtaatgtactcacattgaaagcaatgtaagaagcagttcttattttctacagaaaaagtagtgacagtgaataaaacatcaccttctctgcaatactacaccgcactcataccaattcagcagagtggtaccctgaacacacatacagcttatttctcattagtgaacaaagctaagatttttataaagttttacctttgagccagaaaataaaatgttccaaatatacatatgtacacaccccatttgtggtactttaaattctctagctctaaaactggtgttttgccttgtctttggtttgaaaaagaaaaagggtgcaattagtaatctataacctgtcttatgtgtgtgaagtatgatgaatatgatggatatggagtgtaatgattcattcatatgttaaatatggagtgcggtgaatagcaaaagtaaagctgaatactgttttaatgtgccagatgtattggagcacttttctgctctttggaatataccacaaataattacccaaattttatgcccagaagttgggcttattaaaaaataaacatttttaacatgactgttgtagttcttcactgaggttagaaaatgcataaaaatcagatttccaacttttgtcttaaacttttgatacctttttccctcttctatcatatcagaaaactccttctgttactaacgcttttcaactctgaaattgtatttaaagtggtgatataatttcatttgtaagcaatattctgtttcattatggtaatggcctagactggaaataaacagttacagtgtcactaacatatatatttgatattgatatactagcctagtgtggttttttaaacaccacctaatacatgttttttgtttgtttttttagcagtatgttgagtttatggcagattaatctatcatcttttagaaatttaatatgtcaacggggcatgaaaattttaagtaaaatgtattaattttactcatttttactcaaactattgggtggatttgtttgtatattctaggtgaaaactgacttttgtcagactgtacttccatacttgattcatgatattttactccaagatacaaatgaatcatggagaaatctgctttctacacatgttcagggatttttcaccagctgtcttcgacacttctcgcaaacgagccgatccacaacccctgcaaacttggattcaggtattctattaaatttttaacattaatactgtaaactcagttctagagaaagatggatttaagatggaatcccactaaaagcactttacaggattaaatctataacctctaaatttgtttcttcatctatggaatggagataaaagttgccaacagttgcaacaagttttcaatgaaataatgtgtgtaaagtgcctaggatagtacttgatgtatagtattccctcagtacattttggctattgataatgggtcaactaattgagctttcaatatgtgtcaggcactgtgcttgcactggcaatattaatgtgaaaaagaaacacccacattctagcaatggaaaaaacaaacacaatcagatattttaggtactgtggtgcagatacgatagaattttcatattttcagagctctggccaactcaatttaaaaagcagcctttggccgggcacagtggctcacgcctgtaatgccagcactttgggatgccaaggttggtggatcacttcaggtcaggagttcaagaccagcctggccaacgtggtgaaaccccgtccctactaaaaatacaaaaattagccgggcatggtggcaggcgcctataattgcagctacttgggaggctgaggcaggagaatcacttgaactcaggaggtagaggctcctgaggctcactagccaagattacaccactgcattccagactgaacgacacagcgagactgtctaaaaaaagaaaaaaaaccctttgtataactataattaacatttagtgtatatccttctaattgtttaaaacaaaaattgaactgtactttatttactcttataacctactttccttctatgacatataatgggtatttctcatgccaagagcataatagcaaaagaaattccaccaagggttgggtatgtataatacatatatgcatgcttgaaggctcattatgggtcagttttttaaacctaaattttataaaaggatacaaaattcacagatctttattgttaactgtctttattatatattattaatgtgttttatatgcaaacataaagctaggtgcaaattcacttgttgtacttaaagaccaatcaattctaatacaaatgttgatttaatgtgatattttgccacaactaatctgctcctcccaatccttccagtcacttcagcaaaggttgtgattactcagttcttccaattgtttcttttagttttactgctacaaccttcatttgacatgactctaatgtcatttagacttcagtttgctatgctttatattttatgtattttattttctgttggctaacagcaattacaaatctactatttggaaaaatataaattataaacatagacatagatgcccatcctgtgatcctactagattataggctgttctctaaatgatctagaatgtgcttatatgaattttccttaggccactgaaatgaaaatcctaaaataaaaattctcatagaggctttgtaaactatctaaaatgtatctcttatctttaattgggaaaatacaggtataagtgatttaagcatttaaaactttaatatgtaatttacagtactattaaaaacaatttttattacatagtttaaggtaatcattgtttatgataatctggtaatttgttatcatgaacatggccaagacttttttcatgtttatcacttatgtatttatgtcacaaccattggaaggtaaagtaactgttttattttatctgtatacagtgccaatatttttattaccttaagtgaaaatttaaacttcacatataaaattctgttattgaaaaggaaatacatatttttgtaaaatttaaatggtgtatcttttctgatggctataagcctcattgccttcactaaacgtcccatgtgcatctcaaactcagctgtccaaaagcaaacgtgtcatcttcttcatcccttcccccagcctacttttttaaatgtgtacctttttgacaaatggcactcagttgcttactctagaaacctctctcacgtatttcatctgattaccaaatcttgccaattccatattatgaataacttagtccatttgtttctctctgcccttagcatccttactgctttctagctccatgatttagcacagttgaaattctttcattaaattttccaagttatttcttgcttccagccatctcagatattattattattgcctgtagcactatcctttcctgctctgatgactattactcttctttcagatatcactttttcttttttcttttttttttttctttttttctcttgagacagagtctcgctgtgtcacccaggctggagtgcagtggtgcaatctcggctcactgcaacctctgcccctcaggatcaagcaattcccgtgcctcagcctcctgaatagctgggattacagatgtgtgccagcatgccctgctaatttttgtgtttttaatagagatagggtttcaccatgttggccaggctggtctcaaacttggcctcaagtgatccgtccgcatcagcctcccaaagtgctgggattacaggcatgagccattgcacttggccagtatcactttttctatgaaacttttcttgtctaggtgaggttccctctgctaagcttctgtagcattttaaactttcctattataacacttatcatattgtgttgtaatgtcccaggctagtcagtgagttctgtgtggtctgacatgatctgtcttgttcatgcttatatactgaggacctagcacataaaagatcttattgaatcaattaattagtcctcctttgaaataaaatataaattacaatgtaagttctcactttttttaagataacagtttcttttaaaagcaaaagaaatcctattaaattccttcagaaccaattttgtgttaggtactgcccaccagaaccttatagcatagtgggagacagacacataaacaagaaggaagaaggtgtgtaagcaagaatgcctgggactgaggggagatatttttgtttgtcagagtcagagcactttttccgatgctgtttggataaaaaatcacaaagaacaatgcttgctgttgtggactacatgagaagacaaaagaggtaatgtaatgagtgttgcttcttacgtttaggatctagagtgtaacttgttaactatcggctgaattttaacatgattattttaggtgaaggtgttgcaaagtgttatatttaatttgtgtgatatttatatctccttgcagtaatccatattcaggatagcagtttggttaaatcagtgtcaagaactctcaattctagtaccagctgtaccagtaaccatgttacctttgttaaattatgcagccttcttggctccaatttatttcatctatgttagggataggagcaagtgtttttccaagttacatttagctgtattacccctctttttacttttctctttgctttagttctaagaagtaaatagagttgtgtaaatgtcttctttatgtatctttattttaagatgtaagtttctttactgtgtgcagtggtctcaaaatctgtggcaatactgtgctgtgacaatgtttattttcttgtttctggtaaattgttttatagtatagtatctttgttcctgttatttctcatgagatttttaacagtgcatacagaaattgctagaatggatggtctgactgatgagtactgcttgagagttgaccagaactctgaagaaatagtgtagtaggcctataatttgaataggtaggaatcgatgtctcataagtgtgtatggtggtggtaggggtggttggtaaagaatgagagggagaggtgagtgaaaaatgaaatgtttttaagcctaaatgcattaatatcttaaaaaattaattcctatgtagtcttaaaccattcttcttctctagtagaaaaagaagttttatgcttttcagtgtctttgcttctggttattttaccttagagttttataccagattatcttctgaggaggcctatcagaagctttaatgtagtggagagcatttgttttcttggtgttgggaggcagttttacctttgagtcattcatttcagacttaccattggggtagaatggtgttgacattagcaggagttggagaagataaaaattcttcatattccattttaatgctgaataagatcctgaagaatattcctggagaaagtatgaatgggatatagaaaaacgggtaaagacatgcattcaagtccaagcttgtgctgtgtaaaaattacttgttatcctgtacagtatgttgggcaaaaacaaagaacaacaataaaacaacaacaacaaaaaaattgcttgctgtctttgaacctcagtcttatcatctttcaaaatcagaataatgtctgtagtgtcttcctttccatggggaaattatttcacttctctgaacttaacattcatcggaaaattaactttagttgagtgcttgctgtgtagtagggtgtgccttattcatcagctttgcaggcattatttaattgttgcacccattctccaaggtccatgttgttccagcatttgcaagtaaggaaactaggaaactgaggtttaagaagttaagttgctgaagatcacacagctggtagtaggcaatatagctagatttgaacctacctgtattgtacttcaacactagtgctcttaagcactaccatgtcccatctctacaatgctagttttgaaaaagatactatctatggtccctttcaatcttgacctacctattaacacagtggaagatttttattaagtaactcaacctaggcaatacattaaggagaaaataagtcacaataggaaagacatgtatttgtgtcttagatgaaacaatattttttattaaattgactgttttaaagtgtgtgttggggggtgcttgtgtgcatttgtattagctattctgtgtatcctattcttagtctgtggtacatggatttcttggtagagagcagatatgaaccccaattttgtatcaggtgatagtctacaggttttatcagattctctgataggtttgagggaaaaaagaaaaaccaaaaagattaattaaataggactcttcagccatgttatcttataatgtttataggtatatattggggaaatgtggtttttgggaatttgtaattttctgttaagcagtcactaccattgtattctatatcaacatgcttttattttgatattgaagtttaaaaaagtgaatgacattatatctcatttttctttagaccttcttcaggaacaatttttaatgatgctttctggctggatttaaattatctagaagttgccaaggtagctcagtcttgtgctgctcactttacagctttactctatgcagaaatctatgcagataagaaaagtatggatgatcaagagaaaaggtaatggaatttagaatttttggtttttaaaattaatgttggcattgtctcaataagggtatatagtaaagatttattttgcctcctgttccccatttaaaagatattttagatagaaattttgttttaaagtgaaattataataaatttttaaaaaggaatatgtaattcctgttctgaaataataggaatgcttattacttaggtattataaaaatttaacagatagcaaattcctataggacagagtccatacttaattttctgtatattccccataatagccctagcattgagaacttaatttaagggtgataaatatttttcaaatgattaaattatttcctaacttcagtcagattagatttaccactaatttctaaactattcaagattcattttggatataaaatatccaaaattataatccaaaatggctataatgtgactgatttatttctgtgactaattaagtttcatttctttatctacctatatttctagtgaatttaattcgctttcctctgactgagttagaactgtcataagaatctaataaatatactcctagatcatggggaagaacaaaaaataagaaagtaagagtaaaaaataaagtaaaacactttattatcccaactgctcttttcaaatgtttgttcgtttgaaatggcctgggtctcattatttcgcccaggctgtggtgcagtggtgcgatcatagctcactgtagccttgatcttccgggctcaagtgatcctcctgcctcagcctccaagtagctgggactataggcacacaccactgcatccaactcattttttttaatttttatttttaatagagacaagatcttgctatgttgctcaggctggtcccaagctcctacgttcaagcagtcctcccacctcagcctttcaaagtgctgggattacaagcatgagccgctgcacctggtcccaaattgttttttaaagcggttatacccatttgtgtacagaaatgtagttgataaggaagtggatcggtaggaagccttatatttgaagaagggtgccaaagtataactgttcctagtttagttaaaaaagtaaagaaggttgggcacagtggctcacgcatgtaatcccagcactttgggaggccaaagtgagaggattacttgtgaccaggagactgagaccagcttgggcaacatagtgagacctcagctctactaaaaataaaaataaatcagctgggcatagtggcctgcacatgtagtcccagcaactcaggaggctgagggaggaggatcgcttgagcccaggagggagaggctgcagtgagccatgattgtgccactgcactccagcctaggcgacagagcgagaccctatctcataaacaaaaaaaaaaaaattaagaaactggaatatgtatataggtaaatattagaggcagtatcacttatgatagtatttattttatgtactagattattactgttatagacaccacagctgtcatggttttagaattgaagttacttacagaactgaatgttatatgtataaaatgcataaagttaaggccttgaagtaggcaaatctgagttctaatcctgactgtcaaactttctagttttatagtcttggtttaagtggatcctactgatctacttccttttcaatagttaatatcagatgtcttaaatttatatctgttaagtattaaattctgtcttattgtggtctttatttgtgtgtctgtaattattgattgggttgaatttcaggtgaaaccactgacagagtatatagtacctgaattggatggcatctgctctatttttaaacaatccaatctctttataaataatcatatttttgcatataggcttcccatatgtagattattcttaaaatataattttcattcacaaattccttttccatcctaggtataaatggtattatgttttaaagtataagtgatttattctgttttgtttgccaccttcattagtttttttctgtcaaagtctatagtatatgtattcaggagcttccaaatagtatgttctcattaaaagaggtgttcttgtgacaaacagaagtcttgcatttgaagaaggaagccagaatacaactatttctagcttgagtgaaaaaagtaaagaagaaactggaataagtttacaggtaaatattagaggctctattatttatgacagtatttatctcatactttgggttattttgttatagacactgtacagatgccatgtgatttttaaactgaatttacttactggactaagcatcatatatataaaattatggtctgaagcttaagccttagagtagacagacttgagttctaatactgactctgccacttcttgagttccttatctgaaagacgaaggtaaaaccacctgtctcagagtttatgccatgcattttctgccatagcaccctgttcatttcctttatagcacttagggtttataattatatatttatttgtttgcttgtttattgtatgttacagaagaagcagattgcctcttctataaatttcttgatatccattcttaaattggctcatgttactgtctgggatgcttgccgaatttctttggtcaactcattcctccacaatgacaatttcagcttctccattctgcttaaacctctcatcttctcttctatgccgctgctttcagcctgcctcctacttggagaaaatagaaggcatagagaggaaatctcgccacatcccactctcaaacattgaaatctcctggcatctcctcctttaataatcttccgtcatgttacagaaacagtttatccttctatttgagactaattcttcctgtgctttgtttttttatctgctctttctcaggtgctttattttttaatatgctgttctccctctgaactatgttctgaacattttaaaacctctcctgtttaaaaattccctttctcacaaagacaaaataatttccctcttccctatgttctcttttaggtatcaccctctctcttccttcctctcacagacaaactttgtgaaagagttgtccatatttgctgtctgcatttcccccccttccatttattccagtaaaatagcacttgctaatgtctctcataaacttcatgttgctaagtctggtggtcacctttcattcttccttttccttaatgttttattaatacttcacatcatcaaccatgccttgcttgaactgtgttctgtttacctttttgatccactctcctgatttttctcctttcacttttgccttcttcataggctcctcctctctactgagtttttggaatatcgtgtgtgtactaagcactgtgctaagcatgggtactgaacttttctactctgaggacttgatttcacgttatgaatagaaacatttgagttggaactatagaattatgccaatataaatgaatttgtgtgtagaaaatatttcacagagcaagcaccatataggcagttcaattgcttgatcaattttctatgcagtatagttcctagttttttctattttattttttttatgttttcatttttatttaactgagattgttttaaacagaatatatcttttctgtgtaaattttacaacaaagatttcagtaaccaaactactttatccatatcaaattttaccaattccaatacagttttgtgctatttttcaaagaaaaatccacgacctttattcttaccaaattgagttttcaagagtcagactttgtaggactgtattttctaatgtacagtttttttgtttttttttccagacaggatctggctctgttgcccaggctggagtgcagtggtgcagtcataacacactgcaagctctgcctcccaggctcaagccatcctccaacctcagcctcacaagtagctgggactacaggcatgccccaccatctccagctaatttttgtagagatgggtttagccatgttgcccaggccgatcttgaattcctgagctcaagcagtctgcctgccttggctacccaaagtactgggattaaagatgtgagccactgcacccagcccatgtacagttttaggtgttgacaagattgtttggttttgtttgtgtgatttttttttttttatgtgatataagcctggtaggtcggtacttatttcttatctaattcatgaaattgtaggcaattcttctcgggtagactacagtcctcctgttgtctaggaccagtctactgtgttgctgatccaaatcattagtatatacagttgacccttgaacagtgtaagggttagaggtgctaaccccctgtgctattaaaaatcagggtaaaactaaattagtagtcaaaagttaactactaatagtctactgttgaccagaagccctaccgatgatataaacaacacaattttgtatatgtattatatactgtattcttaaataaagtagcttgagaaaagaaaatgttattgagaaaatgataaggaagagaaaatgcatttacagaactgtactgtgtttatcaataccgtaagtttatatcatctgtttacaaagaatcatctgtctgaaattgtaggcaaccactgctggttgatatgtactttaggcctcaatctacagaatgtatcaaacaattcacctttttcttgtaatggcatgacttttctctgcatcttggaagcacctccagccactgtggtgttaatcaaggcttatagtattgcagtaaacacagtgaaaaaatacatgagaacctggagagattacttttcatttctggatacaatttactagagaaatgaactgctcatgtggaaattattagtgtcacatggcattttaagcagatactcacaacacaataatgcttaccacagtagcaactgaggtagctgcaaaattattacaatagtacaatatgtacgatagttaatcttatgcaattatgatttaatactgcatctttacatttgtttatatttgtcttaaccacaaataatgctgtgtacagtgtgtgtgtgtaagttttgataaattttaactctttgtaatagatttgtgtatattttatggtagtaaatgatgaaatgtatcatatcaaatgtatacaaatgatggaatgtgtagactagttgtacatttattttatgcattcatgacataacttttaaaaaatttttcagtagttctaaactgtgtggtttgtgaattttttcaaattgtggcaaacctccaaaaagttttcaatatatttattgaaaaaaaaatccacatataagttgtcctgcacagttcaaactcgtgttgtttgaactgtatttcagaactgtatttcagaatcattacattttatttctataacataacatttagagttgggagttacatattggtaatgatacaatttaaaatttgctaaatttatagaccgattttttttccttcttcaatttttgttgtttccatgttttcaggatcttctcttagaaatctacagaagtataggggagccagatagtttgtatggctgtggtggagggaagatgttacaacccattactaggtaaattgcatttttctaaacaacggtatagtaattctgtttatgaaggagttatgtgtgtgtaaaacccaaagctattttcacaatcttttcttatagactacgaacatatgaacacgaagcaatgtggggcaaagccctagtaacatatgacctcgaaacagcaatcccctcatcaacacgccaggcaggaatcattcaggtacattttttcccagatttggtaaagccatcactagtgtagtgctgaggttatttcagtatgttggtggatatttacacagccagataaactctagagataagactagaacttatctgtttttcagaggattaggctaaacattcagggatactcctgaagcagagggatgcaaaaaaaagagaaaaaattcagggagacacaggaaagtcagacaggtcattgacctaaaagatagtgtagatttcttgatcatagtgttgttggataacaacagaagacattgctcgagcatatacaatgtgccaggtagtgtacttactgcttcacatggaaaatcttatgtaaactatttctcatagtttgcaacagagttggtcccagaacctgttgtttctattactggctaatactccttagccattcttccatgaaatattagagccctttgagctctatttttgtgttttttgggaaacattaaacgatattttgggattaaaaaaatgtttttggccaggcgtggtggcttgcgcctgtaatcccagcactttgggaggccgaggcgagcagatcacgaggtcaggaggtccagaccatcctggctaacacggtgaaaccccgtctctactaaaaatacaaaaaaaaaaaaaaaaaaaaaaattagccgggtgtggtggcgggtgcctgtaggcccagctacttgggaggctgaggcaggagaatggcgtgaacctgggaggcagaggttgcagtgagccgagatcgcgccactgcactccagcctgggcaatagagcgagactccatctcaaaaataaataaataaataaattttagagataaggtgtcaccctgttactgatgctggagtgcattagcgtgatcatagttcactgcagccttgacctccctggctcaagggcacctctcgcttcagccacccaagtagctggggctacaggtacacactaccatacccagctattttaaaaaaaaaaaaaaattgtagagacaggtcttggtttgttgtccaggctggtctcaaactcctgggctcaagtgatcctcctgcctcagcctcccaaagtgctgagattacaggcatgagccaccacacccagctgatattttgggattttaaatgatattgtgaactaaaatttgtctaagttaatttgtatctttgctgtttttttctctggttttctgttgatatctttgattacttaacttaaaaacaaaataactcctgtttaggccttgcagaatttgggactctgccatattctttccgtctatttaaaaggattggattatgaaaataaagactggtgtcctgaactagaagaacttcattaccaagcagcatggaggaatatgcagtgggaccattgcacttccgtcaggtaagaaatttgacttgatttttttttttttgcctctctcctcattctaaacaacaactgtttttctcttctatgaatataacaggagttgttttatatatatatatatatatatatatatatatatatatacacacacacacacacacacactatatatatatacataccatatatatagtgtgtatgtgtgtatatatatataaaaaaatatatagtagatgttgcaagctatagatagccctaaatccttcagtaagatagcaataagcagttaatgcacctaggcttgaattttactctcttattccattaggacaacttcaccccacccctaaatatttctaaaaacagaaatatgaaaagggttttcgaaatgagtatcatctcgcatagtttgttggactgaggcatgccaagaaaagtataggcattcctctttctacttcctgctacaaacattttagtcagtaagatagcacttatattggctggaggatccacaaaggactgcttatctttatttatgaaatattttcttttattaaaaaataatacggccaggcacggtggctcatgcctataatcctagcactttgggaggccaaggcgggtggatcgcctgagctcaggagtttgagaccagcctgggaaacacggtgaaaccctttctctactaaaatacaaaaaattagccaggcgtggcagcatgcgcctgtagtcccagctacttgggagcctgaggcaggagaattgctagaacacgggagacggaggttgcagtgagctgagatagcaccactgcactccagcctggacaacagagcgagactctgtctctaaaaaaataaataaaataaaaaaaataatatgcctactcagggctgggcacagtgtggtggctcacacctgtaatcccagcacttggagagctgaggcagatggatcacttgagatcaggagtttgagaccagccgggccaacatggtgaaactccatctctactaaaaatgcaaaaattagctgggtgtgctggagcatgcctgtaatccaagctactcgggaggctgaggcaggagaatgcttgaacttgggaagcagaggttgcagtgagccaagattgcaccactgcaccccagcctgggcgacagagtgagactctgtctcaaaaaaacaaaaaaaacactcagttacccaggaagataacatttataatctgtatataaggtcaccatgttttctgaatgaaaagccaagcacctaatctaataaaggatttcatatttatgtaaagttttttgataatgtaaaccctaaaaaattaattatgtttaagtatgttttgttgcctttgtagaaaaaaaaaattattggccgagcgcggtggctcatgcctataatcccagcactttggaaggctgaggagggtggatcacatgaggttaggaattcaagacaagcttgggcaacatggtgaaaccccatctctacaaaaaaatacaaaagttagctgggcaaggtagcatgcatctgtagtcccagctgcttgggaggctgaggtgaggggatcccttgagcccaggaggtggaggttgcagtgagccgagatcatgccactgcactccatcctaggcaacagagtgagactctgtctcaaaaaataataattattggaatgcctttcaaatatttcagactgtaagactgctataaaattagagatatatcctcatattttaaaaaccttttcctgtgcgagttgattcttgcttgcctctgtaaatcaatatatactattcttctccttcctcttgtatttcagctacacagacctctctgtgttttcttgtcaggccaagctgtttctatccaagggccttagatgtatcttctccttttcccccagttaccatgcgggtggcttcttttcattcggaccctagttaaataataatgtatcttcagagaggcctttcttgattacccattctataatagccatctagccattttgttttgttaccctgttttaattctctgcatgtcccttgttactttccaatacttatttattgtctgttcctccaaaccagcacataaattccatgagagtaaagacctgatctgacttgtccacttgtgaattccccttgtgcctagtgcctggcacataataggtatttattgaataaataaatgaaagtagagcatatttagaaccaggcagagtatctgagtaatttcctttttttctgcttaaagaatttaaatgactcataaaatttgtatttcttaccaaaaattctagaaatgcattttttagaatggagaaatgttaatttaaaaattttgtcctttggtgaagctatttatacatgtatatcttagggttctgtttttaagtatatttttttctttgacttatctcacagcaaagaagtagaaggaaccagttaccatgaatcattgtacaatgctctacaatctctaagagacagagaattctctacattttatgaaagtctcaaatatgccaggtattatgaaaagacaaagttactgtattttaacatttaatgtcatggcttcttttctgaaaacttgagaaacaattttaatgtaaggatttgcattgatgaagagataaagacttggtggctgtgatcagatgtttccttgtaattctctgccctccttcaaaacaaattgtttctgggattccaggttcattctttaccctgacccttcaagaaagttttggtgattccctctttgttctcttcctatacaagtatcctgagaattatatcttgtctcttttggtaattgtatggcatttagtgttctaatttataaaattgtaactcacggttaatacttacaaacttgttttgaggcacaaatgtgatgaggcatgaggaaataattataatggggtaaacaaatgcagcatttttaaagccgtagtgacttaataaatcctatgtttatcacagaaataaaatttactatcatttaagtgcctatgatatgctagccactgttagactcttttcatatgtattctctaatcatgacaataactatggatgtgaaaaaaggcttagagaagtccagtaacatgcccaaagttacacagctataagtgacagaactgcaatttagatctaggtctgtgtgattccaaggtttacagttgatccttgaaccacttggaggttaggagtgctgagcccctcctcctcacacatttgaaaatgtgagtattactttgactcctcaaaagcttaactactaatagcttactgttaaccagaagccttaccaataacataagcagtagattaacacatattttgtataagtattataataccatattcttacaataaagtaagctagagaaaagaaaatgttattgaaaattataaggaagagaacatatatttactagtaagtggaagtgggtcatcataaaggtcttcatccttgccaccttcatgttgagtaggataaggaggaagggttggtcttgctatctcaggggtggcaaggtgggagaaactctgagtgtaagtggaccatgcatttaaatttgtgttgttcaagggtcagttgtattttgtttccactgctattttgtattcactgttgcttgttagtattattagatcagtagcaaagcctatgatgagaactctttaacaacaaatttaaacatttatttccctgaaaacctcttctttattttcagagtgtcttttcttttttgctactagagtaaaagaagtggaagagatgtgtaagcgcagccttgagtctgtgtattcgctctatcccacacttagcaggttgcaggccattggagagctggaaagcattggggagcttttctcaaggtatgtaattcgtatgactttgttatcctaaagtgcagcttttctgttaccaatagtgactttaaaaaataaaaactataggccgggcacggtggctcatgcctgtaatcctagcactttagaaggctgaagtgggtggatcacttgaggtcaggagttcaagaccagcctggccaacatggtgaaaccctatctctactaaaaatacaaaaattagccaggtatggtggtgggcgcctgtaatctcagctattcaggaggctgaggcaggaaaattgcttgaacccagcacaacaggcagaggttgtggtgagccgagattgcgccatggattccagcctgggcaacagagcgagactctgtctcaaaaaaaaaaaaaactatgtagagaccaaatgtgtgtgtttctttccttttatcaagatataagttgattagccctagtgaattgtgcttttattaaacattttccaaaatagtcattgtaaaaatttaagttttaaaaattcagcttaagtgtgcttttctctttataactttttccctggcctaccaagataaaattgtttcctcatgtttttgcatagcatgataacactccattcagttttagcactacattgtattactgtcattttatctctgccttgctaaactagaagctcccttaaaagtgggaaccattctattgtttattgttgtatacctagtgtttttgttttgttttcttttttttctttttatgtttttttgagaccaagtctcgctctgttgcccaggctggagtgtcatggtataatctcagctcactgcagtctccacctcccaggttcaagcgattctcctgcctcagcctcccgagtagctgggattataggtgccccgacaatgcctggctaatttttctacttttaatagagacggggtttcgccttgttggtcagcctggcctcgaactcctgacctcaggtgatccacccgcttcagcctcccaaagtgctgggattgcaggcgttagccaccatgcccggcccccaatgttttctcttctggtgactgataattatgtttagtaaacattcagtggatagtggatgtcagttaatttgtaaaaggtgttcagaaggaattgcttcttataatggtgagagggaaatgatccagggattttggaagatgaaatagtatagttactcaggatgctgtagatctaaattctttccttttatcaagatataagttgattagccctagagaattgtgcttttattaaacattttccaaaatagtcactgtaaaaattcaagtttaaaaaattcagcttaaaagtgcttttctctttataactttttccctggcccacccagataaaattgtttcctcatgtttttgcacagcatgttacactccattcggttttagcactgcattgcattactgtcattttatctctgccttgctactagataaaagaagtggaagagttgtgtaagggcagccttgagtctggcaggatgacaaagtaaagtgttttgggtcctcagtttcctcatttctaaagtcagggatttgtattcgatggtctctaaagccccttttagccctgctattttgaattactattattattatacgagggaagaaagaggatataaatgactaaggtcactctacctttatgcaaaaataaaatttggaatatgttttggaagtagaaaagagaaggaaattttagagtcagaagaaaataataatagttttttcaaaatgacatagcagaagacatacatattaatgtggcttaggaggaaaataaaggaacaaaagtcttttctgctttcattcataagtacattggcagtacttactgccagaaatcaagaaatttttcctctgaatgaaagattatcctgctgaaaagagtacagaattctttaagaaacagtgaatagaatggtagtaaccagaggcagggaagggtgttgtggagggagaggatgaagaggggctggttaatgagtgaaaaaacacaggtaaatagaagaaataagatctagtgtttgatagcacaatagggcaactgtagttaacagtaatttactgtatatttttaaatagctacaaaagaagatttggaatgtttccaacacaaatgataaatgtttgagatcatggatatctcaattacccaaatttgatcattacacattgtatgcttgtatcaaaatatcacacgtacctcataaatatgtacaactattatgtatccataaaaattaaaaataaattttaaaaagaaacacctaaagaataatctggctgtttctttggtagagaaataggaagaagagaagcagagggaaggttggatgaactggtgcacaaatgcttatgctctcagattacattccattcatatacatcaaccaaaacattaaataataacaaactaaatgcagaagcagagataagaattcatctcgttctgttaatccagacattaaagagatttgcaaaaatgcaaaacagtgccatgctcactaagttttgttttgttttgggaagtatacagttgaaattctttatctacaggtttccatctatggattcaaccaaccgcagatcaaaaatatttgaaaaaaaaattttaaagaatagggtataacacttatttacatagcatttacattatagtaggtataatatgtaattagagatttatgtataacctgtgcacattctcctattacacgtaatctagaggttatgtgtaatactttttggaaatgtttaataaaagcacaatctagaggttacgtgtaataggaaaatgccctgccattttaaataagggactttgaacatcagcattatcaaggtgtcttggaaccaattttctgcagatacagagaaactactgtagttatttttcctaaaaattgttatttatgatatatagtagatttattatttttgaataaattaatacattttagatttttctcagtctttctaatatgatatcatatctaatatcagtagatatggtccaacgatcgaaagttctttggggtcttcaataatttgtttgattgtaaaggagttccgcaaaaagtttgagacctgctgtggtagggtcatttagagaggaattgaagttttggttcctagcatttttgttactgttccttccctatcaagcaactaaaagagctttcatttcttagtcatcactttgtcatcttactctccctgcttcctctttcttatttctttcaataaatgtccctgaaggattgggtagtatttcatagttcagttatttgggaaggatactattcatataaactaattgtgcaatatgccttttctgttcctttaataatgttggtaaatgaaacctttgccagatgccagcttttccttcactggattgtgatttttttgacagctataattatgcatcaagtcatccccagtagggggtccctcatttccttgctgacatgtcctcattactacaggcagtattgaagcaggactaaagatggaggcattctttatgataggtctgatgaatatgttcttgtttcagaagagtatttagaagggctgctttttgtaatgtcagagtattaaaaattttttttgatgtttgtcatctgtgacctctctgctaataactcttaagagctctgaccgcatagcattttgtagttttctaaattttgatccatatgtaggattatttacaagttctagtcttgtcactacaaaagttcctttgtattattataatattatatcgtaagttccagaacttacatagtttttttttttttttttttcatttctcttgcttacatgaactctatgtcgtggcattcagatcagtcacacatagacaactctctgaagtatatattaagtggcagaaacactcccagcttctcaaggacagtgattttagttttcaggagcctatcatggctctacgcacagtcattttggagatcctgatggaaaaggaaatggacaactcacaaagagaatgtattaaggacattctcaccaaacaccttgtagaactctctatactggccagaactttcaagaacactcaggtaaatacaatttaaaactatgtcatcttacctcttgactttccttttattatttaaaaaacagaaagcctgagggaaaaagaaatgtcattaagagatagagatctctattaatatatagtaaaaataattgtttaagagttcccattttggaattagatctgacttttaagccttgggcaagggtacttaatcttttctcaacctcaatttcctggttataaaatgagaagatacgtaacttactatattgataacaattcagtgattttatatactgtgtgtatgtacacacagatacacatacatacatatagagagagacagacagacagacagataggcagacgtggggtggggagatgtcatgcagacagagaggtccttaagatagtccctgacaagtagttaagtcctcaatgaatggtagttgctgctttcattattattattattcatggtagtagtatcagtagtaaaagtatttattcccatatgtcattttcatttcagctccctgaaagggcaatatttcaaattaaacagtacaattcagttagctgtggagtctctgagtggcagctggaagaagcacaagtattctgggcaaaaaaggagcagagtcttgccctgagtattctcaagcaaatgatcaagaagttggatgccagctgtgcagcggtttgttttttttattggctggattagtgttttactgttatttaaaaaaacacaaatgtactttaaaatatttttaataacaattttattagagccttgaaattagtaatttattaacaagatattgtaaaactagtcttgaaaattaatttgtaaatgaagtttagaaactttttcctatatatcacaattctatcagtccatcatgtggtcgattcatttaatatatcccagtattaagcctttaacttcctatagaattcaagaaaggtatgtgggaaatgaatgaaatagctactctaaatttgaaatgacaagtgaaaaaagggaagaggaaatgaatgagagaactaaattagaaaataaaagcaagttgggacaattaggttgtcaatccaaatgctttgaaaatatcacatctaatattttatctaacattacctgttggtttttgcaaacttatgttgctacttcagctgtaaacccagcatacacactggataaagtagaggcattggtgtccccaaggtttgtctacagtggtgtcccacagacatgtacctgcttagtgaatatcagctcactgtgctttattatttatttatttatttattttttgagacggagtcttgctctgtcacccaggctggagtgcagtggtacgacatcggctcaccgcaacctccacctccctggttcaagcaattcccctgcctcagcctcccttgtagctgggattacaggcacatgccaccatgcccagctaatttttttgtatttttagtagagatggggtttcaccatgttggcaagactggtctcgaactcctgagctcaggcaatctacccgccttgtcctctgaaagtgctgggattacaggcgtgagccaccacgcccggcctttactgtactttttgatgttgggcactcattgtatagcatcttctgttattagagaaatcattataccaaagcactgagtgccaatatgatatgtgtaaatattgcttaatagtattggccctgaagtatgtgctgtctggagttacccaacttccttgtacctcagttttctaatctgcaaattggggtaataatagtacttatttaataggattcttgtgagaattaaatgagttaatatatataaagcctttacaaagtgtctgacatatataagtactcaataaatgtgacttgctccaataatggcaataataataataaacagaggatgatcatttcctacatgggattattaaaatagttgtatggcaaaagcagatgaggaaaaactttttttttcccacccaccaaggaaaaacatttttaacctgcttttttccccgtacatgaagggcagttgggtacagtcatggtaatgcattatattttaagattttgcctttcttatacagaacaatcccagcctaaaacttacatacacagaatgtctgagggtttgtggcaactggttagcagaaacgtgcttagaaaatcctgcggtcatcatgcagacctatctagaaaaggtaagatttttggagcaacccttaagatagttacttagcatgaatatgcttcatcttttcatcaagatcaatatatttccaaagcaaataaaagtatggttttatttttctatatattattactgttgtagctctgtatagtctctagggtggagtgaaacattgttacaaaacaaagcagccaattttgaaagtaagcccaagtatagtatctcttcttcctccttcctacctccactaccagctaccctttcagcaggttgcttctgatcatttcttcatttatgcatctacaaaaataactgattaagaataggcaagtcagcccttgctcttcattagcccagccacccacaagtaaaggcttcaatatactagcccctttgactttcctgtttctccctcttattcctttagattcactaattttggaaatagttacctcactaaataagtgtaacatgaaacacatgatgcgattgtctttcttttcttttcttttctttgagatgaagtctctctctgtcgcccaagctggagtgcagtggcgcaatctcggctcactgcaacctctgcctcctgggttcaagcgattctcctgcctcagcttcccaagtagctgggactacaggagtgtgccaccacacccggctaatattttttatttttagtagagacggtttcgccacattggccagtctggtctcgaactcctgacctcaagtgatccacctgcctcggcctcccaaagtgctggcattacaggcttgagccaccacacccagcctgattgtctttaaattttataaagttctctgtttttgcagagttctttacaagtattagctgtctgggttatttctacactgtcaaagttgttttgaaaagtcaagaaaataccatagttcagggctgtccaatcttttggcttccctgggccacattgcaagaagaattgccttgggccacacataaaatatactaacattaatgatagctaatgagcttaaaaaaaatcacaaaagaaatctcataatgttttaagaaaatgtacgaatttgtgttgggccacattcaaagccgtcctgggccacatgcggcccatgggccgtgggttggacaagtttgcaatagttcatataatttagctagcttttatatgtatataagttaaattttagtgtattaccttaatttgagtgattctttagatgtatttagtatttgtaaatataatttaaattggttgtgttttcttgaaggcagtagaagttgctggaaattatgatggagaaagtagtgatgagctaagaaatggaaaaatgaaggcatttctctcattagcccggttttcagatactcaataccaaagaattgaaaactacatgaaatcatcggaatttgaaaacaagcaagctctcctgaaaagagccaaagaggaagtaggtctccttagggaacataaaattcagacaaacaggtaactaggtttctacaagtgacaattttatgttcaccagttaactgagtgagtgtttttgcatagaaagagtgacttggtctttttatctgatatagttttgagctctaaaggtcggcttaactatatatagattatcttggtcttttgggttcttttcggtttttgttttttgtttttttttttgagacaaggtctcactctgtcacccaggctggagtacagtggcgtgatcactgtactccagctcactgcaacctcgacctcctggactcaattgattctccccctgagcccccgaaatagctggggctacaggtgcacgccatacctggctaatttttgtattttttgtagagatggggttttgccatgttgcccaggttggtctcaaactcatgggctcaaacgatctgcccaccttggccgcccaaagtgctgggattacaggtgtgaggcactgtgccctgtctgtcttggtcctactgtagttaatcacaaattagtatgtaagatattgacgtgttcttttgtgaataattcatgctctgcttctaagttcattgtggagaatatagatattagctttctgttttgcttttttggtttgtttgttggtatcatagtggaaaaggagatagatattgaaattaattacaaaagttacctattttgatgtaattaaatccctttatttaagcctgtcttgaatctgtatattttagtgtaagcagaggtgtaagttagctaaatagcttggggagagtcccctttgtcctttgatgcttaggaaggtgtgtgaattgcacagttaagacaaaagtaagtttattccctttataatccttagaagtttgcttttttccctgggataaaaacccaacttttttcattaaatgttgtatatcatgtgtgattttgtagttctgttaaagttcatggcttttgtgttttaccttaattattctatgcaagatacacagtaaaggttcagcgagagctggagttggatgaattagccctgcgtgcactgaaagaggatcgtaaacgcttcttatgtaaagcagttgaaaattatatcaactgcttattaagtggagaagaacatgatatgtgggtattccgactttgttccctctggcttgaaaattctggagtttctgaagtcaatggcatgatgaaggcaagtgttactcagcccaatattctaccctgtgcttgaaaaacttagacataagccccttgatgtcaggaatcgtgtatacctctttgtattcctagcacttggtccagtgctctacacataagtagcattttgtagttttctaaactttgatccatatttaggattatttacaagttctagtcttgtttctacaaaagttcctttgtattatataagctgacaagctgtaaatgatgcaagtttgtgtggaggtgatagaatttagcttggtcctatgtctttgcagttaccataggagagggtctagaatggggcattagattggaggatttagaaagcagttaaagatgatgtgatcacaggtgggttttccccctgctgcagaaatatgggatttttacaataaattacttttgtaagtagagaaaatatatttttcagaaaatgtcaagacagcagtattgtataagtttttctttgaaaaccttagattatagtgatgacacctaatattaaatttaagttgacaagctatatattgttagtcaatttgaaggttagagataaaatgtttctcctgcaggaaaataataagactcataatagatacagtcaatctctgctgtagtatacactaaatattacttttggcctatggggaaaagcaattacttcattttattgtacactgacttctcaggaatcaagatcacagtcacactcagatcacatttgtcttccttagattttttggaatataaacagtaccaagtattctagttctgaatccagtttaatttaggaccaaatattttgatttaccaatgcattaatctagagtacccattagaaagaccttcagataagaaaagaaatgaaggaaaacaatatagttagtgaagttttgttaaccacttgtgctaatagaggagcactgtcttaaaataacttacttgcttagatgtgagaatatttgaaataccttgtttcttaattttgtgtcttttttttaatggtagagagacggaatgaagattccaacatataaatttttgcctcttatgtaccaattggctgctagaatggggaccaagatgatgggaggcctaggatttcatgaagtcctcaataatgtaagtaaacctgaaaatcaaaccacaataattatttttattctattattactatatattatataaagtatatataccattccctctaagaaatggaaatacaaaattttgtattttttgtcttctcacatcacataagttactcattttctctctctaattcctcataggcctctgcctttttctcacacatgcaggcatacacgctctacccactgcagtatctagacagtaatacacattttaatgttaagcaaaatgaaaaatatggattatatttttttgtttatttgcataaatctaatagttcttttcttacagctaatctctagaatttcaatggatcacccccatcacactttgtttattatactggccttagcaaatgcaaacagagatgaatttctgactaaaccagaggtagccagaagaagcagaataactaaaaatgtgcctaaacaaagctctcagcttgatgaggtatttggattaaacatacgtaccttttagaagtgtgatattcagtctttcctagaatatttctttttaaaatcttgtgttattaagatgccatctaaaatcggttcaaggctggcacggtggctcacgcctgtaatcccagcactttgggaggctgaggcgggtggattacttgaggtcagaagttcgagaccatcctggctgaccgacacagcaaaaccctgtctctactaaaaatgcaaaaaacagctgggcatggtggtgggcacctgtagtcccagctactcgggaggctgaggcaggagaatcacttgaactcgggaggcggaggttgcagtgagccaaggttgcgccattgcactccagcctgggcaacaagagcgaaactctgtctcaaattaattaattaattaattaattaaaattggttcaaaattccttaatatttgtcaaagcataggagataccagtagtagtttacttttttcctcaaagcagttggcaaagtgaaacaatagattttgaaaggcacctaagtcattgacgagagtatgtatctttgatgtatttcatttatgactgttttgtttgtatctgaggaattataatcattccattgtctagatttgtgcataaattctgtttttctctttgtttttctaactctgagaagtttaaatgttgggtagttccttatgtaatgttttttgttttttattaataggatcgaacagaggctgcaaatagaataatatgtactatcagaagtaggagacctcagatggtcagaagtgttgaggcactttgtgatgcttatattatattagcaaacttagatgccactcagtggaagactcagagaagtatgttttttttaaagaagaaacgttactttcttgctgtgttactctctgtagagatatattagttatagagcctaataagtaaatctgcttaaaatcacaaacgtaatccaaaagcttaatttatatctgatggcttcagcattccctggttactttttcacttaatatctcttaatagaactggtaataggtgactacactaaattaattatttgatttcttctgataatcttctggcatacatacttattacagagaattgcataatagaggcaagtctattaaaataattgaataactgaacatttctagcctcaaaagtttttttaaacgatgtggttactaaaactgccctgggacttaaaaacaaaaaaaggctttaccatttcttccataggtgctaaaatgccattatttaattattattcttgctgtgtcagttcaaataattacaagctgctatataatctttggttttgtgactagtctctaagtatgcttctaagtatctccccatactttaataattgtatttttttctattcagaatcatatcttcaagtttaaattcttattacttgaaaacgaatgggacttcacatattgtttctctaagcaaacaaaaagtattgacatgtcttttagttgcatttaatggtaatgtgacaggagtatgttatctatgtactatgcaaactattacgtaattattttaagatgtttagtctggttcctcaggtggaatctggtctagttacccttgtcaggtaacctgcaaatttacttgaagctacattaaccactgttgagctttgactctgagctgcatagtggccaaagcccagagtcttcatttctcaatcagagcctgaaccacagattagcaacaagttggggccagtggtatctgctgactattcctgcttgaccttcaatgctgttcctcagtttgtcactaaaatctcttcatttttaaatacagaaggcataaatattccagcagaccagccaattactaaacttaagaatttagaagatgttgttgtccctactatggaaattaaggtaatttgcaattaactcttgattttttttaaactaaattttttttattagattgaaccatttgaaatagtatttttatgtaggtcaaaattggttaaatattggcaaatttcatatgtttcaacctataatttctcagtattatatttcctttgcccaagccctaaaatactcaaaagcttctcctgctttcttttccattgccttctgttctacacctcccatctttcttatgaaggtctatagactgttactttcattggccagaaggagagtttccgtgtgcttatgccaagattaatttttgacttggcaaggaaggttccaattgtcatatattgtttttaaaaattctatgtgcagtaaaatgtattggctgtgatatatcacagtattaagtaatatagtatgtattattataatattaagctgacttcatatgcatgatacacttagctctgttctaatattcttttattgcaagaaataatggaagtaatttcatgtgggcagggatatatgtaataagggttataagtttagaaaatgatcatcttaaatacattgtctttcttttcattttgcagtttagtgcttagtatctagttacttgatttgaaatgtagctgtatcatgtggattaactgctgtttttctagctatatcagctaggtgatttcgctgaatgtttccttaaaatgccagatttagcagttataacccagaaaactccttctactgttttccaaaatttactttatgttttcgtgaggagttatttctcagatgactttacatatattagtgaatctttgatgaaacagtagttaaagttacgagcgtgagccaccacacccggcctaaagttgtagttcttaaccactatcacatcgtcatttgtttctctgtttaatattaaaattgccatttataatgtatttttctttaagtgcaaatagtgtatctgacctattatcaatcatgtttatacttttattaggtggaccacacaggagaatatggaaatctggtgactatacagtcatttaaagcagaatttcgcttagcaggaggtgtaaatttaccaaaaataatagattgtgtaggttccgatggcaaggagaggagacagcttgttaaggtgagccttcccttctctggcttagcccttagagttttagtgatgaaaatttttagttcatattttctttctgctttatttgggattttgtctttattttgaatacttacaaatgaggaagatttgtagagtagaaatgcattattttctagaaccaggcttttctccattttttttgtgtctctgaaagacaatcattattatatggttgattcaagtaaaagaataccattaacatgtacagacatgtacagtgaggttgcttcttatgaaaaaaaatactttggtgtctgtctcttatttccttgaatagtgcaagttgacgtcctttgcatcagtataccgggtctcgtactgtgccaagtgctatttaatgtaccaaaaagggagagcattcttcccttaccatttgctgacgagctctttgggtcctactggggagtggtggaaagacacagtgctgttttactcaggtgtttgcagtatgccttcctaggggggacttccagttaatctaattacagaagtagcgaggggaaactttctaaatcagtgtaaatgttgtagcttattctaaatgaaagaatggcagtaggtatttaattatttgggagactgtcaagaggtgcacagatgctcagattggtttgagtgccctttgctattctcagatgactctgtgtttttataataaaataaactgtacttgtttattcatgcttaattattctgaagggccgtgatgacctgagacaagatgctgtcatgcaacaggtcttccagatgtgtaatacattactgcagagaaacacggaaactaggaagaggaaattaactatctgtacttataaggtaactatttgtacttctgttagttcaccaaaaacatataaaagatgccatttggttgggtgaagtggctcatgcccatattcataatgctttgggaggccaaggtgggaggattgcttgaggccaggagttcgagaccagcctcagcaacatagtgagaccccatcttgacaaaaagttaaaaaaaaaaaaaaagccagagatgatggcatgtgcttgtagtcccttagctacatgggaggctgaggtgggaggatcacttgagtccaggagtttgaggctgcagtgagctcaaactctgcagtgagccccagtccagcctgagcaacacagcaagatcccgtttaaaaaagaagaagaagaagaagatgccattatttggaccaggagtctacaaatgttttctgtgaaggaccaaataataaagatttattttctttgtaaaaagtatttattaatgttaattatagttaggtgtttcttatagtcaactgaagtattttttccttttttttctactcaacaatatgtcacagaaatctttctcattttttaacagctgcattgtgtgtatgtatgtagttttttatacaagtccttatcgatgggcatttgtgttgttttcagtcttttgctgctacaaacaacgctgtattgtagtgaataaccttgaacatacaaatttcatacatgcgcaggcaaatttgtagcatggatttccaaaagttggattgctgggttagaggatacatgcatctgtaatctggtacatattgccaaattactctcaatgggagtgtacccacttacatttcctctagctatttgcctgagaagacaatcctcagtcacattctatgagctgatcatctttgactcttatattaattattcatttaaccagtttagaaataacaataaatccttattttgaagggcctattttccataggtttgtcttttgtgatttcattcctgtacctcatttttaaactttctccttctataaatgttgtaacagggactatgggtgacatgtgcttttttatatatttctagttttccactatgaacgtgttttatttttaaaataatggctaaattaaaagccctaaataggggagtgaagaagaataaattagatctaccctccaaaatgctgcttgagttaggctattgtaataaaaagcagaacttggttttgagcttcttaactgctttcagagactaaatataaaacttattggttgggagaggggcatactgttcattaaggaaagcacaattttttccgtagccttcaagtttgtgagaaatttgtgacatggaaccttctgcaataataactaacataatagatgttttccattagcagtttaaaaagctaattaatcctcgatgaatgcaaaaagcaaaagttgctctataaaggctactctgtagagggatttctttgatgtggttaagatcattggtactcaagctttagcagacatcatagtcacttagagagtttgttaaaaacacagatttctgatccccattcttagaatttctaattcagcaagattagggtagaacctgtgaatgtgcgtttctagcaagataccagttatgttgatgctgcactggtccagggacaacactttgagacccaccagtctacttgttctaccatctattgacctgacttcattttagaacaaagttgatgatctattagctatctcctatctgacagataatgtagagattgctaagaagtttttagagactagatattctgtaatgtgaatgaaaggaaattgtttatgctctaaataccaaacttttagatgacaaagataataggtgaagaattgggttacaaaagtatgggctataggagcacctcctgaactctcagaaagtagctaagatttccaagcagatacacaattgaacctccaaagttcattgctgtaaagcacaaaaaagcaaatgcctgacctagaatatcttgaaagcagaaattactgaactttcatctctaccttatgactttttcaacagctagttttcacacaaaactattttaccatataagttattccattaagatttctagccgggcatggtggcccacgcctgtaatcccagtacttcaggaggccgaggtgggcggatcacttgaggccaggagtttgagaccagcctggccaacatggccaaaccccatctctactaaaaatacaaaaaaattagccaggcgtggtggcacatgcctctagtctcagctacttgggaggctgaggtgagagaatcacttaaacccggatggcagaggttgcagttgagccgagatcacaccactgcactccagcctgggtgacagaccgagacttcttctcaaaaaaggaaaaatgtctagaggccagatgcagtggctcatgcctgtaatctcagcactttgagaggccaaggcaggaggatcacttgaggccaggagtttgaaaccaacctgggcaacacagcaagacctcatctctacaaaaaattaaaaatttagccaggcatgatggcatgcacctatagtcccagctactcaagaagctaaagcgtgaggattgcttgaaatcaggagtttggggctgtgcatgagctgtgatcatgccactgcagtccagtctggacaacagagcaagaacttgtcttaaaaaaaaaaaagtggggttggggggtaacccagataattaattatttaatgttatacatctcaatattaaagtaaaacctgtaaacacaacagtttaggtttgactatttcttagaattacgacaataagccagtaatgttattttgagattactccaagaatgtgaaagttgtgtcatcattatgttaaactaagtgttcttgcctttagttaaggttccctagactacagcgaagtagtctacccagtccagtcatctgtagagtcattcccaatcctgagattcaggtcttctgtggtcattgtgtcaacaagagcatacattgactacctggaactagatcttggtatacaaaccttgtgtcattgtgcaacctcaaaaggagagacttgtatattgaggcatgccagatatctcttgtcagagagaatcagatggaaatgaagacagttcttattgtgtatgttgatagctcagacatagcccttaacattaaccagaattagggtggctggccccatttttctccaccaaaactatgcattgttacaaagtatactgaacaagtctaaaatcttaggtgtcagaggatttgttttctaaaaggcaagtctctaataaacaatatttaagtgctgaaaggagctttgcacttaacctgatcatcctgccttgtgccaataaataatttttattccttgtcatgcatatttcagagcatctatctcagtcatggttctggggagagaagccataatatcttaagacattcactgaatataatgaattaacttcatttctgtgtatctaggatgatatcagctgtgtactttcagagaactgagaaaatagtcatcagtccttttttgtggtattcacacaaaatacccagatacccagttgaaatcttccagagagtctttagtaccagagaaaacactgtcatttgctttttgaaattcaaattcagctctttctccaacaaccaacatcacagttgagactctaagctgaggtagaaaaaagccaacccattcctttctgtatcaatctctcaacaaaaaataagggtttgattccccctccccgccccagagctagatattgatagagagtaatcaatgtaaaagagactttagacagagtacactacactgcaagaatgttaatgtgatcaagcatcaggggtcacagctaactcaaagacagcaggggagagggcatgtagaatacttattaggcaggaagggaaatcagaaaggccatgagatcattcatttgtttattcaataaatgtgaatttatatacctacgttgggttagatactctactgagtgctaggtctatagaagtagtaaaacattgccctagtccttaaggtgttcacattctaatagggaaaataaacataataaacataattataatgcaaagtgtattgttagagatggtaccaccttcacttggttgctcagactgaaacctagaggctttattttctttttacttttattattatggaaaatttcaaacatacaaaaggagacaataacatcatgaacccccttgtacttgtcactcagtttcagcagttaccaactcatggacaattttgttccatttctctttccaccaacttccttccaatattattttaaagcaagatgtcatatcatttcatctgtaaacatttcagtgtgtagatctgtaagataatgtctgttttaaaaaaccattctcacaatactgtcatcactcctaaaacaattcacaaaaattcctaaatgtcaccaagtaatgggagtcattttaaactcttgtttctctcttctcaagtcttgtctattccatcagcaagtcctattggtcaacttccaggcaggtcactttaccacccctgctattaccaccctacttctgcagtcacatctctgtagatactagagtttaaaccaacagtttacttctgctcttggttttccaaagctagttttattaataactgttagagtgatccttttaaaattgtctaagacagagtactcttattcggtatctgtgggggattgtttccagagccccctgtggatactaaaatcaagtcccttatatacagtggtgtatgaagcatttgcctataacctatgaacctcctcccatgtactgtaaatcatctctgggttacttaaaataccttatatagtgtaaatgctgtgtaaatagttgtactgtattggtttttaaaatttttattttttattgtattgtttttattgaggtttttttggtgaatatttttgatccacagttggttgaatctgcagctgcagagggccagctgtattccattttcctgttcagaaccccacatgagttcacattatccctgaatgacaattctctaagttaagtgatctgcctctgctgttctccctccagccttatctaccactctcctcacactcctctcactttctgcttgtatagatgagtcatctccacctgacttacctggtcttttgcaattgcttagacacaccaatttgtttctgcctcagggcttttctgcttctgcctgcaatgcttttccctcagatcttcacaccagtcactcccttacttcattcaggcttctgctgcagtgttaccctcagaaaggcctccgaccatgttgccattacccactttctctcttttttaaacttaagttttgttctcttatacttattatctaatattatgaaatgtttattaggatatatgttcctcaccagaatgaaactttatgagggcatagtcttcatctgcctttttcccactctgttctcagtgccctagccctgtgtgtaacatgtaatacgcccccaacaaataaatgttaataaattaatcaaatgcttccttaagacacaaaacagttcaacatatgtgagaaacttaaaatttaaaaatgtatagaactaaagacaccataaggacgagtgaccagctgagaaaacgaatataataatgttaattagaacaaaaaggatcattttaatataaagaacaagggatttatatgaagaatacaatgatattcaacttttctagtaatctggaaaatacaaattaaaaccacagtgaaatactattaccctcagattagcaaaatataaaaagcctgacaatattaagtattgcgaaagttatggaataactctactggtgggtatataaatcggtacagtcactttgaatagttatttggcaatatctggttaaccgaggtgaagatgtatctctggctcagctgttaaattcctgggtatataccctagagcagacttgtccaacccacagcctgcaggccacatgcagcctacaggatggctttgagtgcagcccaacacaaatttgtaaactttcttaacattatgagattttttttgcagtttttttttcttttttagctcatcagcaatcattagtgttagtgtattttatgtgtggcccaaggcaattcttccagtgtggcccagggaatccaaaagattggacacccctgcctagagaaactgaaatatgttcacgagtagtttatttcattgcagcagtatttcatggaaatgtggaaacaatgtaaatgttaatatgcagattggataactgttgtatttatgtagtatatagctgttaaaatgaatgatgtagagttaaatatgctcacatagttaggataaaatagtattgaataaaaaaccaaattacagaaatatacatatagtatcctaatttttttacttaatacttacaactatttgtgtacatatagctttgaaataaaaatataccaaaaaatacaagaacatgataaaccagctaacagtcatcttgatggtgggagggacttagggtcagtgaagcacacaagggggagcttcatctcttccccagcaaatgtgagaaaatcctagatttgataaagctgtttaatggataaaagggtatctgttaatatcattttctatactttatgtatgtttataatataattttaaaaaactttcctagtaaagttgcttattttatatttaggagtacattttctctctgtgaagataataagactaaagcaagagtacatgtaatttcaataatgaagttacactaaaattgagaccacattcatgggtaataatttccaagtgaaactccccaaatttaattgatactaaaattttaaggaaagcagttaattcctctcctaactggacaaactaagtatggattaatgacagatgacggtgagtatagttaacaggagtgacctctcagagaatcgtggggattgagtgatgggcaggctctcaaacatctaggcagcaggctggaaaattatattctttgagcttaagtttatttccgattggtttcctccaaggagctttgtcttctatggacagagaaatattaatacaacttgaaaaaaaatgctttgcactgactctgatagctgaatgatcatcaaatgctctttaatggccttttaaaattaaaaggtatttaatctgtaactccaggtggttcccctctctcagcgaagtggtgttcttgaatggtgcacaggaactgtccccattggtgaatttcttgttaacaatgaagatggtgctcataaaagatacaggccaaatgatttcagtgcctttcagtgccaaaagaaaatgatggtgagtgacacccaaaattaaaggttattgtaagattatttaatggcttattaaagctgacagctgtcagatattatagaatacaaaaaaactttaatttcatcaggtaattgtcaaagatactaagtaaaagaaaaactcatcagaatgaaagtgtgtgagtgaaaaaggaaggattttaaactacataatatgtcaacccttgtcagataagaaatgtaaaggttattcaatgtgtgctgatttgttttcaatttgggataaactaattcttagcaaacaaaacactaaaatgccaggcacgatggcatgcacctgtaatcccagctacttgagaggctgagtctgggggatcccttgaacccaggattttgaggccagcctgggcaacagagcaagaccccatctctaaaaaacaaacacagtaaacaacaacaacaacaagattatgaagtaattttttatgaaactgatatagaaaaccttctgagacatttacaatgtcacattggccatctagtctgatattcattcgctgaatcagcaacatttattgtatgttttctgtctaccaggtactgtgctgacttaagacttcacaaatatcaaatattacgactaatcatcataatccttatcctcattttaaaatgagaagttcagagaacttgcccaaggccagtgagctaataaacagagcaaggatttgagccttgtctaaatccaaaatccatttattgttcattttattgtgctttctgtgacatgttttttaaaatgtgtgataagtgctataggtgttgtgatggaagtctgtacagggcacacagggtacagtgtaggtatggaggaggaagtgcttagttctgcctggggtggggagaatagacagaagtagatccaagaaatgcttcacagaggaaaaggtgtgtgagccgagttttgtaaatgagttgtttttccaggcagaaggagcatataagcaaaggagaggagacatgagcaggaaaagacaacataagcataggcttagtgtttgaggaagaaaagatgagattggagcagtaattgttggtcaaaagatggagtgttgctttatgaaatgcaaaggagtttgcaccttatgctataggcctcataagaccctaaaggatagtaatatcagacttgcattttagaaagaaattccgacggcactgtgggttctatttttgagaatgcaaactggaggcatgagatggtctgaactgagatgaacagcagtaggaagggagaatcgtgggtagagatgagaaatatgaaggaggcagaattcataggatttgattgctgattaaaaataaggttggggggcgggtgtggtagcgcatgcctgtaatcccagcacttaaggataccaaggcaggaggattgcttgagcccaggagtttaagaccagcctgggaaacatagtgagaccacatctctacaaaaaataaaaagtcagccaggtaatggtggcacatgcctgtaatcccagctactcaagaggctgaggtgagaggattgcttgagcccaggggccaaaattgcagtgagctgtgatcacacccctgcactccagtccaggtgacagagaccctgtcaccctgtctccaaaaaaaaaaaatgttggagaaaaggagtagccagtgcctcccagttttctgtttggggcagctgggtagatggtgaagctctttactgcattgaagaatagaagaggtgactaaagtttgccagagatgaagtatttgaatttggaagtgatccaagtgaagatgctgaatgggcagcttgagaagcacattaagctaaagcttaataaagatatctgggccaaacagatttagaaatcatcagcacatagatggaagggagttgaagtcggtaagctttgcttcaggtagtattttatggcaagaagatgttggaggatagagatctgagtcatatcagctgccatctatgagggattcttctgttctttctcttttcctgttttctattgcaacccaatgctgtgatgccacctgaggttatctggaactacttaggcatttctgtgtttatttctgcttaagagtacaggattattcaaattagaatttaatcaaaacaagtaacagtcactgtaggtgtgcttcctcccccaacaattaatatggaaatcctaaagggattatcacttgtaattaattgcttccctgtccagactgttagcttcttgtaggtaatgtatcctgttcatctttattgcccctatatctgtcatatttttatataaaaatgtgtatattagtttaattgaacacaatattgaaaaataattatatatattctctatttaaaggaggtgcaaaaaaagtcttttgaagagaaatatgaagtcttcatggatgtttgccaaaattttcaaccagttttccgttacttctgcatggaaaaattcttggatccagctatttggtttgagaagcgattggcttatacgcgcagtgtagctacttcttctattggtaatcttcttgtacatatagtagattgagcactttgttgtttggcaggttttatttttgtttgattcagcactttttctacattctgagttgcagggggatgatagtgatgatgtggttagtaaccaacccatcttcattattaaatcatatgtttcttgttcatcctgattcttagtgtctacctttttataacttatgcagaagagaattctcctacttcaataaataataaaaagacagggttttcttctttgttttatagtgaatatggcatattttctctcctctcaatatattattttctgagactttctttggaaaataatgaaacctgtgataacttatttcctttaattatttttgttcttttgcatataacctctaaatatcatcacctagtgattaatactttttaatagaattttgttttcagaatagaaaccatgagatatatttaaatattttgtgtacaatatatattttgactttttttccctaagaaattagaataggtagatagtatggttaacaaaatcctagagtatgagaactaatgtaaacattagagatcatctaatctatttgttgttttttttttttttaactaaagacaactccctccatcacttacatactataccccaggaaggcagggcatgtatgttttgaaagagttcccaggtaattgtgaaactctcttctacatagagaatcactaatctgatacaactagtttataaacaagaaagtaggcctagttaatgacagagcaagccagacacccagtcattctgattccctacccagtgtgtttttttgtaatgccatgtgatttctcccattagtgcatgtcatcatctgtcttaaatacagaaatgcagttttttggggggatacacacctggtgaaatgaattaatgattaatttgtgttaaatataattcatcaaggagaagaaagtttcactgaagagtgaagagtttatccatagacttctcattttataagtatgttcaataaaaatttgagtacatataatgcacagctttgacccaggtaaataatgggtctcaactttagccacaataattttttaagtactaatattttaaaatgtgtgcctattagtaaagagaaaatttttttagcaaatcatctaggatttgtaaaatgcaatatgcattaaaatagctggcaagatttgagttaaactcaacatggccggttatgcacatcatttaagtaggctaaaaatcctaaactacttaaagattataccaagtcagtggtcttaattgaaattatggctatatattagaaagagatggaatcagtgatttcagattgtttgtttcttttttctccagttggttacatacttggacttggtgatagacatgtacagaatatcttgataaatgagcagtcagcagaacttgtacatatagatctaggtaagtaataaaatctatgtatctattctttttagtaaatatttggtcatcatggaatgttgtttgcctaccaagatattacaaatataagagacagataaattgaagcagtaaatattgggtttttttgttttcagcataaacagttgtcctagaagaaacagttaactctgcctggggtactgagtgaaacttaatagatgaggtgtcttttgagcctggtcttcaagaaagaaagaaagcataattcagacagaagatagagcagattcaaaagaaggaatcagggctattccaccaaaacaaggagtaattttaagatgtagcatgttgtgggagtggtgagacattaaatgtgtctggagtgaagtaagcctgtagttgagtcgcttgagagagagattggtactagactgtaaaaagccaggctaaggagtttcaacttcattgcattaaactataggaaataaatgaaggacatgataatattttattttcagaaatataatttcaggagcactttggggagtggtattggcagcaggaagaaaaattaagggatattgtaatagtttagatgagaaatgatgaagatttatactaaagttgtagaaaccagaatattggatttgagggacatttttgtagtaaactgtaccagtgatattagatgaggaaatagtgggggagtggggcccccagataactgaagcttctaactaaggaatatatcaagttttgtaaatagtaagaaagtgatgaatttagttttgctcattattttgaagtattaatggaatttctaggtggaatagacagtttaatatataagaaagaaagaatatatagcttctatgtatatatatagacagtttaatataaaagaaagagaatatatatagctaaggaatatatcaagttttgtaaataataagaaagtgatgaatttagttttgctcattattttgaagtattaatgggatttctaggtggaatagacagtttaatatataagaaagaaagaatatgtagcttctatgtatatatatagacagtttaatatataagaaagaaagaatatatatagctaagaaatatatcaagttttgtaaataataagaaagtgatgaatttagttttgctcattattttgaagtattaatgggatttctaggtggaatagacagtttaatatataagaaagaagtgtgaatgtaatgtaaagaagtgtgaatgtaatgacaaacttctattaaacagtattaatcactaggtgataatttttagaggttatatgcaaaagaacaaaaataattaaaggaaataagttatcacaggtttcattattttccaaagaaattctcagaaaataatatattgagaggagagaaaatatgccatattcactataaaacaaagaagaaaaccctgtctttttattatttattgaagtaggagaattctcttctgcataagttataaaaaggtagatgctaagaatcaggatgaatatgaaacatatgatttaataatgaagctggtttggttactaaccacatcatcactattatccccctgcaactcagaatgtagaaaaagaagtgtgaatgtaatgacggagatccagaatcttcagcaaatagatttcagttgaagtcactgggctggaggaggttctgatctcacacatcatccgtgataaagagacctaaagatgaaatcataagggaagtgagccttggaaaggctgagccagaaaaaaactgagaagtactcaaaggaagtcaggatcttggaaggcaagaggggaaaatcttttatgaaagaagtagtgctcaatagtatctgatacagaaaggtcagagaggatgaatgctgaaaatagacctttgaatttaacaagtaatcaatcctagaggccttggaagtcccctttggatagaatggaggaaaccatactgtaaaaaggcaaggactgaatggaagttaaggatgtgtagattaagaatgtggaatctgccaggcgcggtggatcacacctgtaatcccaacactttgggaggccaaggcaggtggatcacgaggtcaggagattgagaccatcctggccaacatggtgaaaccccatctctactaaaatacaaaaaattagccgggcgaggtggtgggcacctgtagtcccagctacttgggaggctgaggcaggagaatcacttgaacccaggaagcagaggttgcagtgagctaagatcatgccactgcacttcagcctgggcggcagagcaagactgtctcaaaaaaaaagaatgtggaatcttcctacaagaagtttagaagggaagggaaggatggcagagaaatttgctgcaggaatgagagacacatttggtccttgcttttttaagataggagaggtttaaacctgttagatattgaagatacaggagaaaaacaaaagataattgaaatagcaagggaaatcataaagtacgtgagtctgatagcattggctttagattggaggcatgttagcttttctgctgagagagaaggaaaagtgatgccaataggaaagtcttaagctggagaggaaggagtatgagggaattatatttgctattgtgtttttgctgagaaatagaaagcatgctcatttgctaagaattggagggatggtaactggccttaaaagaacaaataaaattctaaaatttaccatggaaatgagaccaagacctgactagaaagggataaataaataagacatgccaagcagtttaaggggcactttcaatcctaaatttgtagtggagccaatagggttgttgtatgattttccagcagtcctcaacatccttggagcttaagttgtagtttaaaatgggagatgtggtggagggacaaggggacaaggagatttgaagcactgatgagagtaatcaaacttattgtctctacccctgggctgagttagggaaagaagagggctaataaactagaaatctcagtcaaatttgaagactgtttagtaagaataaggggtagaaggagaagaggttttgattagaatgtacaatttacaatgtctaagaagcagttttagcagactcatttctggagtacaacccatatgagtggttcattaagatagaatgaaattgaattccattagaacagagacagtcacggatattatatggttttccccagaatgaattctagagttgggacagaggggaagattgtgagctaggtccatgccaacattcagcgaatgtgagagaaaaccttacaggtttacagagtaaacgtgaagatggaagggatttgttagagctagaaggtggggatctcaacagaggagccagactttatctgagaatgaaaggagagtggtctggaagatgcaaattagaggtaggagtatgccaacctgagtccattcaggtcgtgctaaaagcatctataaatgagaagggtaaattggtacaacccctttggaatattgtttggcattatccactaaagctgactttatgtatatcctgtgacccatcaattccactccaacacaaatgcatacatatgtataaaaatgtttatagtagcattattcataatagcccctaactggaaacaatccagatatccatcataggtagaatggatgaacaaattgtcgtatatttatattctctttgtatataatgagattgaatgaataataacacacaatatagaagactctcacaaatataatgctaagtgaaagattccaacataaaagagtacacatgtataattccatttacataaaattcaaaagctgataaaattaatgtatagtgttagaaatcaggatagtggtgaccctttgaaagaggtgattagtgactggtaggagggactgaaagggggcctctggaatgctggtagagttctgttaacgtggatttgttcactttgcagaaatcccagtgagtcacacttgggtgatttgtatactattctgtgtatgtctgtttggttacctgttgctgcataacaaaccaccccaaaatttagtagcttaaaatcacaatttatttattattatctctcatagtctgttgactgggctcagctggacagttttcacttaggatctctcatgcagctgcagttagcatctggggctggagttatcttaagactcagctgggccagagttcatgattgcttcttcacttacatgtctgatgcttcagcactcccatgtggcctctctgtccacaatagtgtcctggacctactcagcatcttggggctccaaggggaaggaagtggaagttaagggctaggcctgcaacttgcacagtatcacttccatcacattatgtcatcacatagtcatgtcatagggtccatcctggttcttccctgtttctgggactccagtaaccctatgttaggcctttgcaatgtatcatttatactgttacctgctagtctatattttctaacctttttttccttttttctgactcactccttggtgtcagtggacatatccggggaacctggactttcagccctactcagctatagcaagccctttccctattgagtgtcagtggaggccaattggggaatctagtcttctgcccttacctagcagtaacaaggtggtgactcccaaaggcattaaaggcagaagtttaaggaagatcctgagtctcgtaataactaaaaggtgtaggtgtcaattgaaaatcattaggcatacctggaaccaggaaaatctcaactttaatgaaaaatggccacctgtaggtgccaacactgagatgacaatgatgttggaattatctaagattttaaagcagccatcataaaaacactgaaggaacaattacaaacatgcttgaaacaaattaaaatatagtaagtctcagcacagaaataagtagtctcagtatagaagtagatataaaggagaaccagatggaaattttagaacagaaaaatatagtaaataaaataaaaaatttcaactgcagaatgaggagacagaagaaattatcagtgaatagaagacagagccgtagaaattacccaagctgagcaacagaggaagaaaattaagaggaaaccttcagcatctagggctaaacagagttcctagacttgataccaaaagaacaatctttaagaactctcaaaacttaacaacaaaatctacttataaaatggccatgtactacaaatgtgtatagcagctttattcataatagccaagaaccggaaaaatccagatgttctacagtgggcaaatgcttaaacaaactgtgttacatccatgccctgaaatactactcagcaatgaaaagaaacagaactattgatatacataacaatttggatgaatctccagagaattaggctgagtgtaaaaagctattcccaaaaggttacatactgtatgattattccacttccatttatataacatacttgaaatgacaaaattataaaaatggagaacagattagtggctgctagaaaaatagggggtcagagggctgggtgataggctatgggagggaaataggtgcagccgtaaagggcagtatgaaggatccttatgataggaatattatatatcttgactgcatcgatgtcagtagtagtatagttttgcaggacattacagttggggtgaaatggggaaaaggcataagggatgatcttttctgtatgatttcttacaactcgaagtgaacatataattatctcataaaatgtcattaattttttttttttgatggagtttcactcttgtcgcccaggctggagtgcaatggcacgatctcagctccatgtatccttcacctcccaggttcaagtgattctcctgtctcagcctcccgagtaactgggattataggcacctgctaccacacccagctaatttttgtatttttagtggagacaaggtttcaccatgttggccaggctggtctcttaactcctgacctcaggtgtcaggcctcctcagcctcaaggtgctgggattacaggcgggagccaccacacccagcctaaaaattttttaaatataaatatatcatctccattttaaattataccagtagttacttcatttttaaaaatcaccctttaacctagatttctctagttgggttaagaagtagttaggttatttggatttgaggtggatctcacagacagtgacaaagatgaggaaggcagccagagcagaagtaaactactgtacatactagtgttcatagaacgtaggtaacatgtggtttcttgcctttgtaaagttcacattctaactggaaagaaagtaaattagctgtcaaacctcctaacttcactgtattctttactttaggtgttgcttttgaacagggcaaaatccttcctactcctgagacagttccttttagactcaccagagatattgtggatggcatgggcattacgggtgttgaaggtgtcttcagaaggtaagtgatatgaagtaaaggagggaaataatttttgatgtcaaaattacatgggctgggcatggttctttgcacctgtaatcccagctgctcaagaggctgaagtgggaggattgtttgagcccaggagtttgagtccagcctaggcaatacagcaagaccctgtatctaaaaaaatacacacacacaaacacacacacacacacacacacacacacacacacacgggttagagatttgtatagattatagaatttagtgctagaatcgtattccagtgccttatcaatactaaggaaaagaccctgggtaaaagcaataatagttcctcttccttccacccacctgggacctaagcccatgtaacatacatactgttattccaaacctcctctggaagcatcccacctttacttttaacacctctatcctggctgactccttcttaatgatccaaactactattgggtgctcatcactgtgcatatagaagagactacatttttatttataggagcttgtgttctagtataacattgtgctactaaaaaagctttgcagttccttgtagttttcccagcataggtctgtgtactcaacttggattggggcagattgcagtcagtgtaaactaataattgccacaataatcaaagactgagagctgagcccagtggtgcatgcctgtaatcaatagtgttgtgttattcttgtaaatgccaagcttgtgaaatagtcaaatacatatttgtattcatttcaaacgtctaatgaaagcccactctgccaagtattatgctattttgagatacagatatgtagattattaagcataggctcagcatactacacatgagagtatacagataaagatacgttgacaacattggtgtgtaacaaaatccgtatttataatgtgtttgactctagatgctgtgagaaaaccatggaagtgatgagaaactctcaggaaactctgttaaccattgtagaggtaaagtattttataaggaagactttattttttttcttaccaggtagactgtgtatctcatcaggaagtcactgatgtgaagagcactgcttcattttaacatagggggatgtggctgggcagcagaaaggaggagattgtgcacttagccttttcacacatccaaaaatactggtttagaaatgccttcagcccccttgagtttcttggaatgttagagcattgtaagtagtctctagttttcaattcataaatcaattctttgacatttagatattccatatggtattattattttcagaatggtttccattagggtttaagaaaaatcagaaatttatatctcctttttccctgctcaggttcagaactaattagtcagacaaatggagatcaaattgtcagcatcattactagaggaacatggcttaggaatgagggccagactagtttactgctggtgctacctcagtacctctctgctgtcttaactttgggacagctcacctgaatagggtttgggcctgcagagcaaacacatgtaatcaggatcactgccttgtcttgatccagggcagaaaaaaggaagtcaaacaaatttcagtgtctgtgctgttagtacctatgccagtcattcaccaatctggtaagggtatgtgagacaagaaatcaggagtgtggcctccccagggaagcatggcaggtagagtgcagtatgggcttgccacttttccactactcagcttttcttcctttaacctgatttatgttggactggctgcatgttagtattacttttactgcatttaaaaaacattgatgctgatcaaattcaaaccaggtttctagagatggggcaggaatatgtgcatttttaaaaatctctcctactgttcaactaggatatgagaactgtcttaattcattggcattaaccattaagcctgtggtcaataagggtggggctttatcccttggaagatgagtaacagtccatcagggtggtcctgtgtgcacctttatgaaccgaggcatctttatagatctcctttggactgcagatggtaatacagattttgctacaaggagtttgctgaaataggtcccaataatacgttggtaaaattaaatccaaggctgtgctattcccaaggttaaaaatacattcttttttcttttaccgatttcaaattctgttcatacatgttgtcatttgttacagtttgccattggttctgcagtaagaataaatgataagaaaataagcatgatgtgtaacattttaaaaaaataatacatggtaacatggatgcctcaataatgtcgaaattaaactctaaagttatattatcttgcactttttcatgtaagaaaaagagggctgggcgcggtggctcatgcctgtaatcccagcactttgagaggccgagacaggtggatcacctgaggtcaggagttcaagaccagtttggccaacatggtgaaaccccgtctctaataaaaatgcaaaaattagctgggcgtgatggcgggcacctgtaatcccagctactcaggaggctgaggcaggagaatcgcttgaacccaggaggtggaggttgtagtgagctgaaattgcaccattgccctccagcctgggcgacaagagcaagactctgtctgtcttaaaaaaaaaaaaaaaaaaaagcccaaacttttcaaattaaagagtcaaagcagcttaacatattctttagtattttactctacctagtttcagtcagaagggatttttatgctaaggtggatttgggagtttcttccagtacttgtatcctacctaacactcaccagaagaaggtagttcttttagggcctcagaaatcttactagtttaatgccaaactgcttatggacttcactttttagagtagtaggagatcaaatgagagaagtgacagtggccagatcctttgccattgtaaggactttggatttcctttgagtgagggttttgagtctgaaaagtgatttgcatctccacctacaataactgtcacctttaaacacaccctccgggaggaggagccaagatggccgaataggaacagctccggtatacagctcccagcgtgagcgatgcagaagacaggtgatttctgcatttccatctgaggtaccaggttcatctcactagggagcgccagacagtgggcgcaggtcagtgggtgcacgcactgtgcgcgaactgaagcagggcaaggcattgcctcacttgggaagcgcaagggtcagggagttccctttcctagtcaaagaaaggggtgacagacggcacctggaaaatcgggtcactcccacccgaatattgcgctttttggaccggcttaaaaaacggcgcaccacgagattatatcccgcagctggcttggagggtcctacgcccacggagtctcgctgattgctagcacagcagtctgagatcaaactgcaaggtggcagcgaggctgggggaggggcgcccgccattgcccaggcttgattaggtaaacaaagcagccgggaagctcgaactgggtggaacccaccacagctcaaggagacctgcctgcctctgtaggctccacctctgggggcagggcacagacaaacaaaaagacagcagtaacctctgcagacttaaatgtccctgtctgacagctttgaagagagtagtggttctcccagcacgcagctggagatcggacaacaggcagactgcctcctcaagtgggttcctgacccctgacccccgagcagcctaactgggaggcaccccccagcaggggcacactgacacctcacacggcagggtactccaacagacctgcagctgagggtcttgtctgttagaaggaaaactaacaaacagaaaggatatccacaccaaaaacccatctgtacatcaccatcatcaaagaccaaaagtagataaaaccacaaagatggggaaaaaacagaacagaaaaactggaaactctaaaacgcagagcacctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaataagttgacaactttgaaaaaaatttagaagaatgtataactagaataaccaatacagagaagtgcttaaaggagctgatggagctgaaaatcaaggctcgagaactatgtgaagaatgcagaagcctcaggagccgatgcgatcaactggaagaaagggtatcagcgatggaagatgaaatgaatgaaatgaagcgagaagggaagttcagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggccaacgttcagattcaggaaatacagagaatgccacaaagatactctttgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcatcagtgaagtagaaataaaatactttacagacaagcaaatgctgagagattttgtcaccaccaggcctaccctaaaagagctcctgaaggaagcactaaacatggaaaggaacaaccggtaccagccactgcaaaatcatgccaaaatgtaaagaccatcgagactaggaagaaactgcatcaactaacgaacaaaatcaccagctaacatcataatgacaggatcaaactcccacataacaaaattaactttaaatgtatatggactaaatgctccaattaaaagacacagactggcaaattggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagaaacaaagaaggccattacataatggtaaagggatcaattcaacaagaagagctaactatcctaaatatatatgcacccaatacaggagcacccagattcataaagcaagtcctgagtgacctacaaagagacttagaatcccacacattaataatgggagactttaacaccccactgtcaacattagacagatcaacgagataaaaagtcaacaaggatacccaggaattgaactcagctctgcaccaagcggacctaatagacatctacagaactctccaccccaaatcaacagaatatacatttttttcagcaccacaccacacctattccaaaattgaccccatagttggaagtaaagctctcctcagcaaatgtaaaagaacagagattataacaaactatctctcagaccacagtgacatcaaactagaactcaggattaagaatctcactcaaaaccgctcaactacatggaaaccaaacaacctgctcctgaatgactactggatacataatgaaatgaaggcagaaataaagatgttctttgaaaccaacgagaacaaagacacaacgtaccagaatctctgggacacattcaaagcagtgtgtagagggaaatttatagcactaaatgcccacaagagaaagcaggaaagatccaaaactgacaccctaacatcacaattaaaagagctagaaaaggaagagcaaacacattcaaaagttagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaagaaaaaagagagaagaatcaaatagacacaataaaaaatgataaaggggatatcaccaccgatcccacagaaatacaaactaccatcagagaatactacaaacacctctacgcaaataaactagaaaatctagaagaaatggataaattcctcgacacatacactctcccaagactaaaccaggaagaagttgaatctctgaatagaccagtaacaggagctgaaattgtggcaataatcaatagtttaccaaacaaaaagagtccaggaccagatggattcacagctgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaaatcctcaataaaatactggcaaaacgaatccagcagcacatccaaaagcttatccaccatgatccagtgggcttcatccctgggattcaaggctggttcaatatatgcaaatcaataaatgtaatccagcatataaacagaaccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccagagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccactgtctcagcccaaaatctccttaagctgataagcaacttcagcaaagtctcaggatacaaaatcaatgtacaaaaatcacaagcattcttttacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatggcatccccatcaagctaccaatgactttctttacagaattggaaaaaactactttaaagttcatatggaaccaaaaaagagcccgcatcggcaagtcaatcctaagccaaaagaacaaagctggaggcatcacactacctgacttcaaactatactacaaggctacagtaaccaaaacaacatggtactggtaccaaaacagagatatagatcaatggaacagaacagagcccttagaaataacgccgcatgtctacaactatctgatctttgacaaacctgagaaaaacaagcaatggggaaaggattccctatttaataaatggtgctgggaaaactggctagccatatggagaaagctgaaactggatcccttccttacacctgatacaaaaattaactcaagatggattaaagacttaaacgttagacctaataccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcagtcattaaaaagtcaggaaacaacaggtgctggagaggatgtggagaaataggaacccttttacactgttggtgggactgtaaactagttcaaccattgtggaagtcagtgtggcgattcctcagggatctagaattagaaataccatttgacccagccatcccattactgggtatataaccaaaggactataaatcatgctgctataaagacacatgcacacgtatgtttattgcggcattattcacaatagcaaagacttggaaccaacccaaatgtccaacaatgatagactggattaagaaaatgtagcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaatatcacactctggggactgtggtggggtggggggcggggggagggatagcattgggagatatacctaatgctagatgacgagttagtgggtgcagcgcaccagcatggcatatgtatacatatgtaactaacctgcacaatgtgcacatgtaccctaaaacataaaagtataatttaaaaaaaactaaaaaaacaaacaacaaaacaaacaaacaaaaaaaacacaccctccaatgctttgtgtattttacactcatctacctaatcttccctccgtaaatctgtccgaatttccccaaatcatttggtgtgattgttccaatcttcaagaataattttcccagtgatcttaccacagtaagaccctttctgccttcagctttaggagggtgcttctcaattagcatcctggttcccagtcctctgggacatcatttctttcctctcttggattcatttcttttcttctcttagatttcattgaggcacagtcactatttctgaactgatctccccgcttcctaagcccctccttcagagcactttaacctgggtgtatttcccttttcttttcagtgtatttgtctctcctggccttcaagattttattttcttcctaatggaccattctctcctctaagattttatgtgttatgctaaggaaatatatctctccctctaactcagtgatgcttagccaagagcagttttgtcccctagaggacagttggcaatgtctggaggcatttttattgtcacaattggggatgggagatgaggatagtattggcatctactgggtagaggccagggatgctgctgaacacctcagaatgtacaagttagcccccacagcaaagaaataccccatccaaaatgacaatagtgctgagactgagaaaccctgctctagcttaatcagtctgtattcctttactgtttccaaccacttctgtcttgtcagactgaaacataattttttacttattccagttcctccttaattctaatatttgcaagtatgattcctgacacaagcccttggttttgaagtaatttagatttttcttctacttcaacccaagaaaaccatctagtctgtattagaggccttcattccttttcattagttcattaataaaatatattaatatttcccttttgtgggtgaaactggtttggatctctgaaatctaaagccatgtcagtgcccaacttgaagtcacataggaaaccttgaacttaacggacaagctacatgtaatcaagctcagtttctccacagtatttaatggtcctggaggacactcaaaacagcattaaaaaatagagagattttggttctgctaatctagtacgtgtcctgaaactaaatctgctaaaggcattttatagtcccaacctgcagatttactgagaaactgtatacagatagcagcaaaaaagtgttccaaccttgtaatactggaatgccctgtagaatcattctttatattgtctccacttattactaagatttgtaagcatttgctaaagcctattttttttaaagttctgtgtttataaataccagagcagttagctgttctgaactgccaatatcagaaattcctcatgaactcactttctaaaatttacgacctaaagctacttgctctagccatgtcagttgttttggtatcctaattctacacctaatatatatctcaagattccaaacgcagcaccaaaccttgggttttgaggaggtttcaacaaattatacctttctggatccacccagatttagaactgagagaaaaagagccataggaatagggtggagatcagaatttcagatttgttactgataaaactattggagaagacggcttaggagtgaggtccaaataggcttgctggtgctctccagttcccacatcccaatctataccttgagacagcctgggctgaggaagaattgggccctacaaagcaaatacactaacccagggttaagagtagagagagaaggaaagaaagtgactaaccttttaatagattagtttcatccagtcaggaaacatgggtcaagggatgtcacccctaaccatggaggaagaatgaattcagaatgaaatgagaagcttggagcattatgctaggatagtttcctcaaggaaacatgaagtgtgcatgatgtttgttcccctcccccatcaactaccatgtgactggcttatttgtatgatactggttctactgtttctaagtatgtgattaaaatgtacattgttcttttaatacatatgttctctctgtttaggtccttctatatgatccactctttgactggaccatgaatcctttgaaagctttgtatttacagcagaggccggaagatgaaactgagcttcaccctactctgaatgcagatgaccaagaatgcaaacgaaatctcaggtgagcagtattttaagaaggtcctgttgtcagtttttcagattttcttattcccaaggcctttaaactgttcacctcactgaaacctttgtgtttttgtccttagtgatattgaccagagtttcaacaaagtagctgaacgtgtcttaatgagactacaagagaaactgaaaggagtggaagaaggcactgtgctcagtgttggtggacaagtgaatttgctcatacagcaggccatagaccccaaaaatctcagccgacttttcccaggatggaaagcttgggtgtgatcttcagtatatgaattaccctttcattcagcctttagaaattatattttagcctttatttttaacctgccaacatactttaagtagggattaatatttaagtgaactattgtgggtttttttgaatgttggttttaatacttgatttaatcaccactcaaaaatgttttgatggtcttaaggaacatctctgctttcactctttagaaataatggtcattcgggctgggcgcagcggctcacgcctgtaatcccagcactttgggaggccgaggtgagcggatcacaaggtcaggagttcgagaccagcctggccaagagaccagcctggccagtatggtgaaaccctgtctctactaaaaatacaaaaattagccgagcatggtggcgggcacctgtaatcccagctactcgagaggctgaggcaggagaatctcttgaacctgggaggtgaaggttgctgtgggccaaaatcatgccattgcactccagcctgggtgacaagagcgaaactccatctcaaaaaaaaaaaaaaaaaaacagaaacgtatttggatttttcctagtaagatcactcagtgttactaaataatgaagttgttatggagaacaaatttcaaagacacagttagtgtagttactatttttttaagtgtgtattaaaacttctcattctattctctttatcttttaagcccttctgtactgtccatgtatgttatctttctgtgataacttcatagattgccttctagttcatgaattctcttgtcagatgtatataatctcttttaccctatccattgggcttcttctttcagaaattgtttttcatttctaattatgcatcatttttcagatctctgtttcttgatgtcatttttaatgtttttttaatgttttttatgtcactaattattttaaatgtctgtacttgatagacactgtaatagttctattaaatttagttcctgctgtttatatctgttgatttttgtatttgataggctgttcatccagttttgtctttttgaaaagtgagtttattttcagcaaggctttatctatgggaatcttgagtgtctgtttatgtcatattcccagggctgttgctgcacacaagcccattcttattttaatttcttggctttagggtttccatacctgaagtgtagcataaatactgataggagatttcccaggccaaggcaaacacacttcctcctcatctccttgtgctagtgggcagaatatttgattgatgcctttttcactgagagtataagcttccatgtgtcccacctttatggcaggggtggaaggaggtacatttaattcccactgcctgcctttggcaagccctgggttctttgctccccatatagatgtctaagctaaaagccgtgggttaatgagactggcaaattgttccaggacagctacagcatcagctcacatattcacctctctggtttttcattcccctcatttttttctgagacagagtcttgctctgtcacccaggctggagtgcagtggcatgatctcagctcactgaaacctctgcctcctgggttcaagcaattctcctgcctcagcctcccgagtagctgggactacaggcgtgtgccaacacgcccggctaattttttgtatttttattagagacggagtttcaccgtgttagccaggatggtctcgatcgcttgacctcgtgatccaccctcctcggcctcccaaagtgctgggattacaggtgtgagccaccgcgcccggcctcattcccctcatttttgaccgtaaggatttcccctttcttgtaagttctgctatgtatttaaaagaatgttttctacattttatccagcatttctctgtgttctgttggaagggaagggcttaggtatctagtttgatacataggtagaagtggaacatttctctgtcccccagctgtcatcatataagataaacatcagataaaaagccacctgaaagtaaaactactgactcgtgtattagtgagtataatctcttctccatccttaggaaaatgttcatcccagctgcggagattaacaaatgggtgattgagctttctcctcgtatttggaccttgaaggttatataaatttttttcttatgaagagttggcatttctttttattgccaatggcaggcactcattcatatttgatctcctcaccttcccctcccctaaaaccaatctccagaactttttggactataaatttcttggtttgacttctggagaactgttcagaatattactttgcatttcaaattacaaacttaccttggtgtatctttttcttacaagctgcctaaatgaatatttggtatatattggtagttttattactatagtaaatcaaggaaatgcagtaaacttaaaatgtctttaagaaagccctgaaatcttcatgggtgaaattagaaattatcaactagataatagtatagataaatgaatttgtagctaattcttgctagttgttgcatccagagagctttgaataacatcattaatctactctttagccttgcatggtatgctatgaggctcctgttctgttcaagtattctaatcaatggctttgaaaagtttatcaaatttacatacagatcacaagcctaggagaaataactaattcacagatgacagaattaagattataaaagattttttttttgtaattttagtagagacagggttgccattgtattccagccttggcgacagagcaagactctgcctcaaaaaaaaaaaaaaaaaggttttggcaagctggaactctttctgcaaatgactaagatagaaaactgccaaggacaaatgaggagtagttagattttgaaaatattaatcatagaatagttgttgtatgctaagtcactgacccatattatgtacagcatttctgatctttactttgcaagattagtgatactatcccaatacactgctggagaaatcagaatttggagaaataagttgtccaaggcaagaagatagtaaattataagtacaagtgtaatatggacagtatctaacttgaaaagatttcaggcgaaaagaatctggggtttgccagtcagttgctcaaaaggtcaatgaaaaccaaatagtgaagctatcagagaagctaataaattatagactgcttgaacagttgtgtccagattaagggagataatagctttcccaccctactttgtgcaggtcatacctccccaaagtgtttacctaatcagtaggttcacaaactcttggtcattatagtatatgcctaaaatgtatgcacttaggaatgctaaaaatttaaatatggtctaaagcaaataaaagcaaagaggaaaaactttggacagcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattataaagtgtttttgaataaataattctaaaagc

SEQ ID NO: 34 - DNA, 129592 bp, Homo sapiens
ttccgggaggagttttggcctccacacggctccgtcgggcgccgcgctcttccggcagcggtagctttggagacgccgggaacccgcgttggcgtggttgactagtgcctcgcagcctcagcatgggggaacatggcctggagctggcttccatgatccccgccctgcgggagctgggcaggtagggctaggcccagcctgggtcctgcatcctcctccgctgattccggcttgggtttcacgtgctctcccctcccctgctgcgctatggctgggatcccctaagcccccgctgcggcccttgtggagatgctccgtggctgatttgggcgcttctccctcagagtgcccgttgatagcacatggggcagtcgccacaaacctgcgggaagccggtccgtgggggagagaggcgtctgccggccctggtttaccactcaccccgatcgagagtttgcttcctgcagctggaggaagagtccctgctgatcgctttctggtcacttttctacactcattttcttctcgaaaatctttttccttagacgagggacttgacccatcagtttctgttctttgtgatcactcgtggaggaattggtttttagccttacattttgtccccaaactgcccttgaaagaaaatcaccgcttctcattttctgcaagtgacatcacttgctggaaaaggcagtttttttctttgaagtgaagtcatagtacatactgaagatgtgacctccctcgtattgatcgtccagttcccgatccgttattttagtcagaaattggagagatagacccctgggtccacaaaatctcagcgtgcacagagtgttgccaaaatttggagacaatttaatatttcatttgcaaatgcatgttgtctgtaaacctcatgaaaaccagtatcttaccacaaggagggagaggtgttgatggctctcacacctcttcaatacacaggcaggcttccctgaaccaggcctaaagactcggtagagcttgttttgctttgtttgttttaattctacactactgcgaacaagaaataaataagcttgtgctgctaccgcagttaaattatcatttggaataactgcttcccaatttcttaaactgtttgaaaactttccacacaaagtcaaagctgacattaagccaatgggatagctacttctctttctttttgcagcgcagttgtgttcatttccactggttggccatccaaataatctagtctcaatatatgaataaaaggataaatgaagggaccattcttgtcgtaactgcatcactatttttgagtgtgtgaattttttccacttatctgtggcaagtatactttgtgtttagtttataaaataacctctacctctctaaaagaagaggaagaaaagtgatcattgtaggaagttggtttacaaatttcatctttcaggctcattgtgaagctgagtatatttttgccactttgctttaaagtagaattaactggttaatacttctcttccctcttctgtcttcctccgtgagtcctgttaataaaaataattggttcttggattatatatagtcggtttcatcagtagagtttatgttacctttcatttatttgtagctattccaagagaaagaatagaaaaactgacccacagagagttgtctaatagtttttaattgtcatggctttttcattacaactacttgaatcaaaaaagctaatcaattttcatagtatatccatgacatagaatgaaacaagtgttaccactgtttaagaaaaagggacagagaagttgaagaaccaaaggcacagctagcagataacagagctaggtttcagattcaagctttcaaggccttttcttccaaaatgtttcctcttaattgactatggcaattagactactgaaaaaaaaagatattagtgttctaatttatgggctgctcttcctcagtccctcagataaattttgtcctattgtttttttgctattagcagtctgctctgcataatcttgctaaatgacctttccactctcctgccttcaactataatctgctatttgatgactactaatatgtttctccaaatcatgtcttctatagaattgtatatttactgtatactggtagtttcactgagtgtcctatgtgtagttaaggttcagaatatccaatacaaattccccacatgtcctagctttcacaagctttctttttttaaattaaaaaaattatttttctcttattcattgaagtagagatatctcagtacatggcaccatattcacttagttctccaaactggaaatctagaagtcattcttaactattttcacatgtgctttcagtctatgtccttggccctcttttaatctgtgctgtcttcccaagtaatcttacctaatctcatggctttaaatgtcatccatatgctgataactcccaaatttatatttctagatcggagatatatattaggttgcttactcaacatccacactgggaagtgaaaattaacatatccaaagcagaacgcctgatttactgcgcccttgaatttgttccttctcctgtgttatcgtaaatatgccaaccaaaagcctaggagtcatccttggtttttttcccttgtcgcttaataatccataagttagttctgacaaccatatgtttaagatacatctagaatctaacacttctcactgtctccactgctaccaccagaatttcttacctgaactattacagtaaccttagttgatctttccatttctacttttacctacttataatagattttccactcagtaaagtgatttttcatctattagtcatattgtaagttcccctgcacaaaaccgtcctttgacattccagcacacttaaaatcagtataaaatccaaactccttaccaaggcctctaaggttctacataatctggctcagcctgcctctgacttcatcaccttttatccctcttttgcttactttactctagtgatactgaccttgtttctccaggataccaaggctgttcctgcctttaatcgtttgctgttccttctatctgaacactggatggtttcatttagatgtcatttcagaatcaccttctctgattttcctacttgagattgctttgtagttgtaagacattttcaaatgtgatagttgctattaaaatgttaaatggaacagtgggatgtggaggaggttctgaggagcagcagcattagccactagaggagatttgatggtgtaaagaagctagtcacgtgaatctgggatggaataggaagtacaaaggcccataagtgggaatgagcctgcttttttttttttttttttgagacggagtctcgccctctccagtggcgtgatctctgctcactgcaacctctgcctcccgggttcaagcgattttcctgtctcagcctccctttcctgtagctgggactacaggcttgcaccaccgagctaatttttatattgttagtgaagatggggttttaccatgttgcacaggttgtctccaactcctgacctcaagtgatgcacccacctcagccaccatgccaaggctgaatgagcctacttttaaaaggatagtaagaaggctggagcacagggagtaaagaggggagtggtatgagttaaacagggaggggtaggcaagggccacatccttcagcaccttggaggctagaaaaaggagtgagattttattgtgtgatgggaaaccattggaatcttttaaacagggaaataagcaagttttttaaaacttgcttaatttttacttccttaaaatccttcagtgcttacacattgccttcagtgtaaaatccaaactacttagccagtcctttgaaatttaaccttatcttccctcttcagctgcatctctaaaggctttagccacatagagcctcttacagtttccagtgcttggactaccctccctcttacccttatttcactgccttgtcccttagggagtcagttttgtatcacctcgttaaggaagccatgactgacagggccctgctcagggctgagtgtccctttgtgttctttcttgggcctgtcagttcttaaccataattacctcttgtttgtcctttaatctgcaaattattttagggcaggtgcattctgtcttggttatcctggtatttgatgcttacctcagaggaggtgcctaagctttatataatacttacattaatactcaaattttatagtatgcttttgaaaagttataccctcttagctcagttccagggtagaagtcacaaaataagaagtgctcactcctgtgagttttctttcttttttctttttttttttttttttttgagactggctcacctgttgctcaggctggagttcaatagcatgaacatgtctcactgcaacctctgcctcctggggtcaagcgatcctcccacctcagcctcccaagtagctgggactacaggtgtgtgccaccatgcctggctaatttttgtatttttgtagacggggtttcaccatgttgcccaggctggtctcaaactcctgggctcaagtgatccgcccacctcagcctcccaaagtgctgggattacagacatgagccaccacgcccggccaagtttctttcttctgatagtagatctaatgaatggtaatcaatttacatttttctaaaactgatttttaaaaattacacaaataatacatgagtacataatctttacaaaatgaaactttgtaagaaactctgaccactacccacaatcctggctcctcttcccatgttcctctttgttcacatttttaaatgatacttgtgaaattactgtggtttatcataatgtctcctgactttgtctaaaacaattcatgttaccttgtaattacagattttgaattttttgttaaatttgtgatgccctatactatggtagccactagccaaatgtgaccattgaccacctcacatgcggctagtctaaattgagatgtgctgtaaatataagatacacagtgggtttcaaagacttagtaccagaaaaaagaatgtaaaagatctcatgaataatttttatatcgattacacattcacctaatatttcagatatattgttaggatcaattgtttttttcctgtttcttttcttaatgtggctaccagaaaataacaaaattatggcttacgttatatttctattggccagcgctgatttaaataagatacatagcactaagttgttttgctttcatatgcaaatgtaactacttgttctttgattcttttttttttttaaggactttatttagtagcatatacaaacttgcttttttttttttttttttttgagatgaagtctcactctgtcatccaggctggagtgcagtggtgcgatcttggctcactgcaacctccacctccatgtcccagcgattctcctgcctcagtgccacagcttcccaagtaactaggattataggcgcccaccaccacgcctggctaatttttctatcttttagtagagaaagggtttcaccatgttgggcagcctgatctggaactcctgacctgaagtgatcagtccgtctcagcctcccaaagtgctgtgattacaggcatgagccaccacgcctggccctttgattctttgtgtctagagtttatgttacttaaaaacatttgttaatttcagtaagtttttctattaagcaagttctaggtgatgtagcagaggcaaaaagaaataaaatgcattttctctcctataagagcttacggtctaatggcactttaggacatgcagagagaaataaagcacagtctgccacctgtaggagcttatagtctagtggcagggaataggtaaatattccataggtccagaaggctgtacattaggaatgaagaaaccacaaaattcaggaaggttcttatgaaccattcattcattgaagagttgtttttttttctttaaatgtctactatgtaccaggaccagagaacagttcttttttttcttttctattttttggagacaggggtctggttttgtcaccgaggctggagtgcagtgacacaatcttggctcactgtagcctcccaggctcaagcgatcctcccacctcagcctcctgagtagctggggactacaggtgtgtgtctctatacctgctcatttttctatttcttttgtagagacagggtttcatcatgttgctcaggctggtctcaaactcctgagctcaagcagtctgcccaccttggactcccaaagcactgggattacaggcatgagctaccatgcccgaccagtatcagttcttttatggcatttattagctgtaaatgctattgatcctatatgtaatcaattaggattggactttgtggtttgaataatcaaaaaaaaaaaaaaaaaaaaaaaaaaagtcaggccgggcgtggtggctcacgccgataatcccagcactttgggagaccgaggcggatggatcatgaggtcagtaaatcgaaaccatcctggctaacatggtgcaaccccgtctctactaaaaatacaaaaaattagccgggcgtggtggcacgtgcctgtagtcccagctactcgggaggctgaggcaggagaatcacttgaagctgcgaggcggaggttgcagtgagccgagatcacaccactgcgctccagcctgggcgacagagcgagactccgtctcaaaagaaaaaaaaaagaaaaagggccgggtgcggtggctcacgcctgtaatctcagcactttgggaggctgaggcgggcggattacctgaggtcaggagttcgagccagcctggccaacatggtgaaaccccgtctctactaaaaatacaaaaattagctgggtgtggtggcacacgcctgtaatcctagctacttgggaggctgaggcaggagaattgcttgagcccgggtggcggaggttgcagtgagccaagatcgtgccactaactgcacttcaccctggccgacagagcgagactctgtatcagaaaaagaaaaaaattcactctttttcttttaccactatttgagataataagtggggaaaatgtatgaacattttacagtgctatatagaaataaattgtgacatatatgaaatatatgctattatttataagtaactgtcttactacaccctaagttgttttgtcagaagtgatggactttgctaatcactcacacataacccactgtgaatcctctaggtagagttaatcattccctgctttgggtgtacatgatacttgcttttgattatttatttatttatttatttatttatttatttatttatttattgagactgagtctcgctctgtcgcccaggctggagtacagtggcgcgatctcgactcactgcaatctccgcctcccagattcaagcgattctcctgcctcagcctcctgagcagctgggactacaggcgcccgccaccacacccagctgatttttgtgttttcagcagagatggggtttcaccatgttagccgggatggtttagatctactgacctcatgatccgcctgccttagcctcccaaaatgctcgtattacaggcgtgagccaccatgcccggccgcttttgattatttaagtgcattcctctcctctccccagcaactattctgagttctttgaagcagaggatcttgttttacttgccttttgaatttattaaattatttgcgtctgtacccatccattctttctatgtttatgaaagagttaccctcctgtccaaggattgtctttttacttatatctggttccaagaagaggagtcacatctcaagaattggttgcttaggtctttccattataagggagaaacaaaacaaagccctcttgatctcatacagttctttagttatcaccaactctacttctcttcatttcatgatcaagctttggaaagaacccgctattctcagtattcacatttcattagattttcagccccttgcaatctggcttctctctttactgctacaggaaaattttaaaagtccaaaaggcatacaaatacctaaacataagaactaaaactatgaaactcttagaagtgaacatagagggggccgggcatggtggctcacacctataatcccagcactttgggaggccaagatgggtggatcacctgaggtcaggagttccagactagcctgaccaacatggagaaaccctgtctctactaaaaatatacaaaattagccaggcgtggtggtacatgcttgtaatcgcagctactcaggaggctgaggcaggagaatcgcttgaacccaggaggcggaggttgcggtgagctgagatcgcgccattgcactccagcctgggcaacaagagtgaaactctgtctcaaaaagtaaataaataaataaaaataagggaacatagagggaaaacattatgacactggatttggcaatgatttctttgatatgacacaaagcacaggcagcaaaataaacagataaattggaattcatcaaaattaaaaactttgtgcatcaaagggcagtatcaatagagtgaaaaggcaacccatggaactggagaaaatatttgcaaatcatatgtctgataaggagtttaatatctagaatatattaagaactcctacagcttaacaacaaatataacctgatgaaaaacagaaaaagaacttgaatagacatttctccaaagaagatatacaaatggacaaataagcacatgagaagatgctcacaattactaatcattagggagatgcaaatcaaaaccacaggatactgtttcacacccattatgatagctattaataaaaaaacagttggggctgggcatgttggctgatgcctgtaatcccagcactttgggaggctgaggcaggcggatcacgaggtcaggagattgagaccatcctggccaacatggtaaaaccccatctctactaaaatacaaaaaattagccaggcatggtggtgcatgcctgtagtaccagctacttgagaggctgaggcaggagaattgcttgaacccgggagacagaggttgcagtgagttgagatcatgccactgcactccagcctggtgacagagcaagactctgtctcaaaaaaaaccaaaaaacaaaaaaaatcccacaaaaaaaaaacacagttgggcatggtgactcatgcctacaatcccagcactttgggaggtcaaagcaggcagatcgcttgagcccaggagattgagaccagcctgggcaacgtggtgaaaccctgtctctacaaaaaatacaaaaaattagctgggtgtggtgacatgcacctgtggtgccagctactcaggaggctgaggtgggaggatctcctgaggctgggaggttgaggctgcagtgagttatgggtgcaccactgcacagtaacctgggcaacagggttagaccctgtcgccaaaaggggaaaataaaataataataaaaaaacacccagaaaataacgtgtgttggtgaagatgtggagaaattggaacccttgtccactgcaggtgggagtgtacaatggtacagccactgtggaaaagggtattagcgttccaccaaaaatttagtttttatgtgcttcagaagggaggaagtgaatgctaattggtccataggcagtcatgggtgggcctggaaaaagcaccctaagttctcgctgtggtccgtgtaactggcagccaggcttccaggcttcaagctgttcctggcttgaaggtgggtcttcactggggacccacccctttcctcccaggagcctacttcctgctgccatcaacctgccacccactacaccgaggctgttcgtgccgaggggcgcctgcaggcccatattgagctgccctcagcctaccgcttggcctgcccaaagtccagagggagatgaggcagcagggggctggtgtgtcagtgccgtcctgagcacatgcacacgcggcctggtcctgacaacacctgggctcccccacaactttgctccgaaattggtgtgggtgccgggagcggggagaggccaggcagcgggagcaggcatttccaagtctgtgagggcagggggccttcccggccctggaaagagcagggatgcctgggtttgcagccgtggttgggcggctgcagctgcacccaggatggctgggctcccgaccctgcaactcggaagggggcggggcttccacctgtcttgcacctcagaagggggcggggcttctgcccactagcgccctggagagagcagccctagcaccaccttcctcaccgctccaactgggctgccactgccatcaatagcacatttcaatttgtactaatcacatttcaagttctccctagttacttgtagctagtggccaccatattgagaagttcaggtctaggctttgctgattggatctctttagtattacttagcatattcttttttttcttgtaagttggtaacatattcagattttcttttcaatttttaaacagaagaatactgtgaatatcaacattgacactgaacacatttgatgagttctactttagagaaattttttttgcaaatgaaactgagtcactttaaggattaaaagcttttaatttgtattttagtgccacaccagaggaatataatacagttgtacagaagccaagacaaattctgtgtcaattcattgaccggatacttacagatgtaaatgttggtaagaaaccaattatttcttatataaactttataaattagacttttcttttccatgtataaattatagtagcattttctccatgtagttttagatatggagtatttatgatagttactattttcaagcaagttatttgttaatcagtattgcttattgcttgttacaaaatttgaattaggcttttaaaataattctcttttcctgtttgttatctagattttctactgcttgctatgagttctttaatattggatattatatgtaaaaatatttgtccagtaccaatcatgtggaccctattttggttagctgttatgccagtggtagactaatagcaaatgccacccaaaaaaacctctttaagtaagttactctttaagtaggttcatgcctgtgcctataggagattataggattatgtgagttactgaatcaattattgcctgtttgtgccaatctgctagacagaatattaccaacctggcaagatggtgtcacatttgtcatatctgttgaaattacatgggagggataatataaaatggcattaggctcagggtttataatttggattccaaatttggcgcagattttatgacttagactagccattaatcctttctttttcaatcagtaaaatgatgggttgctgaaaaataacaaaggactactgaatacttacaagatgtgtttttgtatcgtattcatattccctccgtttagactacttgcccttcccctctctgaccaactcctcatctaggaatcatttccttcacagtgtcctcccagatacctgtttctccttattctggattagtgctgttaccatattgtattataattattagttggtttgtttggcgccccactggattgtgagaacttttttttaatccttagattttagcattgcctggcatattattcctgaagtacatgtttgataaatagatgtatggtagaggaatgcatgtgatttttaaacatttaaaattagataagactgtagtgttggctgggcacggtggctcacgcctgtaatcccaacactttgggaggccgaggtgggtggatcacctgaggtcaggagtttgagaccagcctggccaacatgacgaaaccctgtctctactaaaaataccaaaattagctgggtgtggtggcacacacctgtagtcctagctactcaggaggctgaggcagaagaatcacttgtaccccggaggcacaggttgcagtgagccaagatcacaccactacactccagcctgggcaacagagtgagactgtgtctcaaaaaaaaaaaagactgtagtgtttagccccatcaatttagcttgaatgttgttgagtgctgtgctggatataattctggtcaccaaagtctggttccccacccccaccccactttttgtttttttttttttaattttaagagacagagtcttgctttgttccaggctggagtgcaatagtgtgatcgtagctcactactgccttgaacttctgggctcaagggaatcctccagcctcagccccctgagtagctgggactataggcacactaccactcccagctaattttaagaaaaattttttttgtagagacgggatcttgacatcttatccaggctggtcttgagttcctgggctcaggtgatccgcccacttcagcctcccaaagtacaggggttacaggagtgaggcaccttgcctggcccacagtctggtttcttaacaaaaggaccattgtttaatttgtcatgactctttaaaatgaatcttattgttttagttgctgtagaacttgtaaagaaaactgactctcagccaacctccgtgatgttgcttgatttcatccagcatatcatgaaatcctccccacttatgtttgtaaatgtgagtggaagccatgaggccaaaggcagttgtattggtaagtgctgttattcatgcattcacttgccatctgttctataaaatcctccttttactgctcttctgaaatattacatgtacaggattatacttttttgggtcagctttgctataaattgaaggagcaaaatggtaatggttatttttccttcacatatccttattgttttctttttagtattgtatactaggtacttagaaataatcaaatttgtttatttgccattgaacactttggcatggttttcttttttctgtttttggtaatctctttcttctagatcagagcttggcaagctgtagtccacagggtggctgcctgtttttgtgaacaaagttttggtgttttgttttgtttcctttttttttttttttttttttttttaaataagacagggtctcgctatgttgcccaggctggtcttgaactggtagactcaagggatcctcctgcctcagcctcctgcatacctgggaccataggcacatgctactgtgcctggcttcagtttttgtaaacaaagttttattagaacacagccatgctcattcttttacttattgtctgtgactactacaaaggcaacttgggcactcaagccaaaaatattactatctggtcctttaaaaaaagtttgctgaccgctattctatatattgaagcttttctctaggcttattctttattgcacctactacttttgtcccttcattggtgtcttcataaagagatgcaaaataaacattttttttgtataatggataaagtattttaaaattttttgttcaaactttaactcaactttgatagcatgtcctccaagaagtttttttctgagcactacttctaactgcttagaactggcttggttattcctttattctctcttagtactaagtgttctgcatttcatctatcatagaggctattaaactgtgctctaatcattggtttgtctatattctttcctacagtagtttttaaactacaggtcataacccactagtgggttatgaaattaggcaattatcagcatttaaaacaagatgaaataaactagaaaatatcataggctgggcacgatgtctcacgcctgtaatcccagcactttgggagttcgagaccagcctaggcaacatggcaaaatcctgtctctaccaaaaccaaaccaaaccaaaccaaaacaaaacagaaaaacattagctgaacatggtggcacatgcctgtggtacaagctacttggaaggctgaggcacactaattgctttagcctgggaggcagagattgcagtgagctaagaccatgccgttgcactccagcctgggtaacagagtgagaacctgtctcaagaaaaaaaaaaagaaaatattatagtacattgtatgtaataagagtaagtactatttaatgaaccttttgttttaaatatttaaataaaatgcatgtatatgtactgggtcatgatataaaatgttatttctttgttgcagtcaaaaagctcaagaaactgtactgtgagattcatgaggacaggactatgactgatttattcttgtgtacctgagacagagtcaccactcaaattttagttgaaagaatgacaatagctaccctttattgaacatttattttactttggaactgtgctgagtatttcatgtgcattttcttatttggtcctcacagtaacccataacatagatagcattattctccttatacatgaaattacagaggttcagagaaatgaaaagtttatacaactagtaagtggaaagctaggaccttgcctgtctgactccaaagttgttacaggcatacctcagaaatattgtgggttcagttccagaccactacaataaagtgaatattgcaataaagtaagtcacatgaattttttggtttcccagtgcatataaaagttatgtttacgttgtaccttaagtgtggaatagcattatgtctaaaaaacaatgtatgtaccctaattaaaaatactttattactaaaaaatgctaacgattatatcatccttcaacaagttgtaatatttgtgctggtggagtgtcttgccttgatgttgagggcctttctctggattaggctttggcttaagggaatgttgtggctggtttgatcttctttttttcctactggaaatttcctcatcttttaacgatttgatcttctattcagagtacaaaaactttctccataccagcaataaggctgtttcactttctcatcaatggtgcgttcagtggagtagtacttttaatttcctccaaaaactttttctttgttttaacaagttggttgtttggtgaaagaggcctagctttcaacttgtcttggctttcaacatgccttcctcagtaggcttaatcatttctagcttttgatttgaagtgagagatgtgtgactcttcctttcatttgaacacatagaggccattgtaagggttattaattaacctaatttcaatactgtgtctcagggaatagggagacacaaggagagggagagagatggggaactgctggtcggtgggtcagaacacatacatttatccattaagtttgccaccttatatcggtgtggttcatgacagctccaaacaattacaatagtaacatcaaacgtcactgatcacagatcaccataacagatacgataataatgaaaatgtttgaaatattttgagaattaccaaaatgtgatacagagacatgaagtgaccacatgctattggaaaaatggcactgatacacttgcttgatgcagagttaccacaaccttcaatttgtgacaaatgcagtatctgcaacgtgcaataaaactgggtatgcctgtgttctaaactattatgtttccattgtgaagagaatgttttacactcttgttagtgaagtttattctttaaaagtcaatcgtcaaggatttagcaaatgaattagcacttcggatatacttgtttatttaatatcttttttgtttatttcaaagaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagaggtaagtaatttttcaggttactagttaagtatgtattttgttcatcatttaattgtatacatatgtgcaaaatgtaataataagaaaatagaatatctttaatagtaatttatatttggaacataatgattttcatagtgtagtctggctcactattatggacttttactttgatttcagaaggatttgttcattaagttggtaatgaactgccaatggagtagaatgtttctaagtagaatctgtgaagtgtaaatgtatttgttgcattattaattaaaagggggcagttaccaacttaattgcagaagctttggtcaatcagattatgtgtctgacaagttataatcaatcacttttagaaaacctatgaatgattaatcatgccaaattatgcgcttttttctatttggactgtgggagtcaggtaatacaataaaatcatcagagatgcagtaacttgattaaatattttagtttattaatcttgctggattaaagttacatgaagaaagttggtaattcccttacagaattttttataagggaattaaaatttatagcattttggtaagaggaaaaacaggatgtagagagaaggatttgtttaaaccttctaagactatagaaccatagtctatatatagacttaaataatatagatcaatttagatgtttattttgctttatgagactctaaaagtagtttcactagaaaacacctaacatctaatacattcttgctgcctatgaataatataaatatattttctaaggaatatttctggaaattattttttattttctcagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggagtatgatgaccttcattcagtttgtatttagccattaaataaaactttgttcacttttaaaaatcagctttagttaagtgctttgatttaaatacacaaagaacatctttctaaatgtagccaagggagtgcttaaaatatttttataattattgtagacggttagtagtataaaacatttcatggttaaatatagttactttgcatgtttttatatgcttatctaatttaactttttaatatgtgaaaaatctttgagactgtgcatctattagcaatttttaaaacattaaccaactattttttataaagtggctaagttgccatatttcagttacttctgaacattgttttaattgttttaaatcttagtataaatttcaggctgggcgcggtggctcacgcctgtaatcccagcactttgggaggccgaggcgggcagatcacgaggtcagaagatcgagatcatcctggctaacacggtgaaaccctgtctctactaaaaatacaaaaaattagccaagcgtggtggttggcgcctgtagtcccagctactcgggaggctgaggcaggagaatggcgtgaacccgggaggcggagcttgcagtgagccgagatggcgccactgcactccagcctgggagacagagtgagactctgtctcacaaaaaaaaaaaatttttttgaatagttgatattacatagtatgttttattctaaatatgtttcatgttttaaccaaatttatattgcatatgaatatctctctactatattcataattatagaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactggtaaaacaaacttcttgtttcttggggttgggtttcctgtaatgaacttggatttactgtttactcattattcacttgactcatgtaaccttagaacacaaacttttcactgaagtagttaataaatttattttctattgagtcaaatgctaggtacggtgctaagcactgtatatatcttagttaatatttacaatagtcctgtaaggtaaaggctattatgcctattttaaaaattagaaactgacactcagagaaactgaggctcttttttgtctgaagccaaaactgactttcctggggacacatgattagaaagtaccagaacacatttgtgtacaactcaaaacccagtgtttggctgttgaagacagggtctcgctttgtctcccaggctggtgcacagtggcatgatcatggctcactacagccttgatctctatccggggctcaagtgagcctcccatgtagctggaactataggcatgtgccgccacaccctaatttagaaaaaattttttttgtagagatgggtttccctatattggcccggctggtctcaaactcctgggctcaagtgatcctcccacctcaggctcccaaagtcatttggttcccaaatcctaagggtgatttaagctgacataaatagattcaacttaaaatagtaataacatattacttgatttgcatgtttactttaaattgttatagataaatttcgtactcacaatttcttttggctttactacaattttatgtttgactataacaaaattcatcttaattccaatgtttttaacaaaatgtacttactgcagccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaaggtgagtacaaattagcaacagatcagaataacctttaaagataatcagtatagaaatatgctttcttttttgcctgaagcctaagtgcgtgtttggaatactcagaagttttttcctgatttcagttctattaaatttgtcaataatagaagttctgagttgccaatttatgtgcataatattttgattctttagtcaatagaaattatttataacttcaaagttttttaatttgggagtttgaggaatgccgtgattcttctttaaaacaggcatagataacatgtttttataaagtcacatttaatttctttgggttcacagacctcagaccatcgtttatagatctctgtgttaagaatttctgcttatccaatgatcattatgatagtatttcaaatgtctttatttttatttaaaagagatatgattaaggaaaagttataattaatgacttattttgtgcttctgtagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattgtaagtgctcacaagaatgtgtgtgtggtttgttttatttatctatctatctatctatctatctatttatttatttatttatttatttatttatttatttttgagacggagtcttactctgtcgcccatgctggagtgcagtggcgcaatctcggcttgctgcaacctccgtcttcaggttcaagcaattttcctgcctcagcctcctgagtagctaggattacaggtgcgcaccaccatacccagctaattcttatatttttagtagaggcggggtttcaccatgttagccaggctggtctcgaactcctgacctcaagtgatccacctgccccagccttctaaagtgctaggattacaggcgtgagccaccatgcctggccttgtgtggtttgttttaactcatctctatataggacttctaagacttatttatatttttttcaataattaaaagagcaggtacatttttaatagttcagaagggggttagatacataaaaagtaacacataaaagcctgccccacatatcccatttcctttctttttgtaaaacatttgcaatgtgtccttacatatcattatcttcatttaataaaattaggaagtatttgagaaatattttaaaaagaagaacaatataccaaaaattcttataccaacttctcagtttaagaaatagaaacattaggccaggcacggtggctcacgcctgtaatcccagcactttgggaggccaaggcatgcggatctcttgaggtcaggagcttgagaccagcctggccaacatggcaaaacctcatctcttctaaaaatacaaaaattagccaggcatggtggctcacgcctgtagtcccagctactagggaggctgagatacaagaatctcttgaacccaggaggcagaggtttcagtgagccaagattgcacccctgcactccagcctgggctattagagatatgatggaagcctttgtccctctatgatttcattcccctcatttttttccccagagattactactgttctgaatttggtgttgattgttctgttgaatgttctattacttttactatatatgtatttatttataaataatataagaaattgttttgcttcttacagcttacattttgttgatcaacactatctttatgagacttatccatggtgatatgggtaactctagtttttatttaaacttccaaatagtagccaaatttggatggacactatcagacctcctattggtggacaatcaagttgtttccaacttttcacaattacaagcaacatttaaatgaatatttttataaatgattctttagtcattctaagtccttgctgtttgaaaagtatgctccacagaccagtagcatcgccaccatttagggacttgttagaaatggagcgtctttgattctgctgaaagagcacattaaaaaaaaagagagagaaagaaagaaatggggaatcttatgctccacccagacctactgatcagaatctgcattttaacaagataggtgattcatatccatattaaagtttgagaagcattattttaacgtttttacctacctaggagtagtattgttgggttatagagtttgcacatcttcacctctattctgctgtattgttctccaaagatacaccagtttacactcctgttagcagagtatgagttccacatcctcactgacacttagctgactttaaaatttttgctatctagaaaataaaaaatgtcatggagttaagtatcttaaattttttctttttcctatctggtaggtatgattttcaatttgcatttccttgattatttagtaaggttgtgtatagacctttttcagtgcacttgctttattttctgaaaaggagcttttaattaaattaggtattaaatgtattttaagtgttacttgacttttatttatatatatgtatacacaaatgttactttacttatatatatgtatatgtgtatacataaaattaacattagtagaaatcttgtttaatagacttaattttttcagcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatgtatgtactaagattttaatttgaatatatcactctattggaaagatcataattgtctggctatgtatgcagggttgtgtttattgttgaatatgtaaagcaaatgttgcttttagttttagaatttaacattttttccttctaggctttgttttaccagtacttttgtcccaaattaagcaagactatttagaccacaaaattaggcaagaaagtttagtactttttcttttttttccccagagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttggtgagtgattatgacttatttaatactttaaaacctatttaagctctgcttttcaaatcagtaaaagaattagactgaagccttgaaaaattacaggaagttacatgctttatagattcagtgctcagtattgattagttataaatgggataactggtattagatcgcatcacaaaactggtaggagaggtgattttgggatttttcgaatactcttgtgatttgacagcctaaatggggcatacctgatggttgtttcaatattgtaagattcaatattagattatcttctttagtgataccagagatcgtcttaatgtgccccctgttacaaccttggaccttgagaacttcaaatagttaaattactttgcccaactgaggactatagagtgtatcttcttggccactttccagtggtaatggagtataaatttttatgaagtatgagatttatacaaatacttagaagatccatttgtttaggtagtaagttgaaacttgttctgaagtttcaatagaaactttctattgaaagcaatagaaagtactccctaaatcttgtaatgtaaggttaacaataaagctaagatccccttgagaaatgtgcttttctttttttctttttttttttttccccgagacggagttttgctcttgttgcccaggctgaagtacaatggcgccatcttggctcactgcaacctctgcctcctgggttcagacgattctcctgccccagcctccggagtagctgggattacaggcgtgtgccaccaggcctggcaaatttttgcatttttagtagagacagggtttcaccatgttggtcaggctagtctccaactcctgacctcaggtaatctacccactctgtccccccaaagtgctggggttacaggcatgagccaccatgcccggcctttcttctttctttttttttttttaagagacagggtcttgctctgtcacccaggctagagtgcagtggcgcaatcatggctcactgcagtctgcatccttgatctcccaggctcaagtgatcctcccacctcagcctcttgagtagctggaaccatagtatgtgccactacacccagctaatttttaaattttttgtagagagggatctcactttgttgcccaggctggtctttgaactcctagcttcaagtgatcctcccaccttggcctcccagagtgttgggattacaggtatgagtcaccactcctggcctgcaatgtgtttttaagtttatcttggtaacatataatggtctacaaaatctgaaagagacttgttattttataacaattctggaaattattttagatttaaattatttataggctgagtgcagtggttcgctcctttaacaccagcacttcgggaggccgagacaggcggattgcctgagctcaggtgttcgagaccagtctgggcaacatggtgaagccccatctctacaaaaaatacaaaaattagccaggcatggtggtgcatgcctgtggtcccagctacttgggaggctgaggtgggaggatcacttgaacctgggaggtcagggctgcatgctgcagtgagccgtgatcatgccactgcactccagcctgggtgacagagcaagaccctatatcaaaaaaaaaaagtgacatttattaaatataaagtaattttaatttataagtatccattttaatttcctaaaattctgtgtgctatacatacttaaatatgaaacattgacattataagagaacttaggattcttcatggcatattatttgttgacaatatttttacagtacaaccttgacatttaatatgttaaattaggtattgtatactcttgtccttcagctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggaggttgataatttttgtttttaacatttgagtttacgtcaacctagctctaaaaatttctttaaccagttaattttattgttctagctttttgtcttaagaatgaaggaagcatatacacatgcccaaatatcaagaaataatgagctgaaggataccttgattcttacaacaggggatattggaaggtatacttggcagcatttgtgttcttccttatttattttggccattctccatttttatttgcttgctgttaaaaatggtgatatgatatttgtgatattatagacaaaatgtgagtcaacatgaatttatttgtagatttccgtttgtttctgggatattggagatacatatgtgtgtgtatgtgtgtgtgtgtgtgtgtgtgtgtttgtgtattcatatgtatgttgtttttaattttagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcaggtaagagtcagcgtttgtctggactataggcaacagcagtactttttaagagttacaaaaaagaagaatatttatacatgttttattttgcttgcttttcttttttcttcaatttatattttaagttcaggggtatattgcagcatgtagaggtttgctacataggtaaacgtgtcgtggtggtttgctgcacaggtcatctcatcacctaggtataagcccagcatgcattaactattatttctgatactctcccttcccccaccccccttacaggccccagtgtgtgttgttccccccatgtgtccatgtgttctcatcattcagctcctacttataagtgagaacttgtggtgtttggttttctgttcctgtgttagtttgctgaggataatggcttccaattccattcatgtccctgcaaaggacatgatcttgttcctttttatggctgtatagtattccatggtgtatatgtaccatattttcttcatccagtctgtcattgatgggcatttaggttaactccatgactttgcttttttttttttttttttgagatggagtattgctctgttgtccaggctggagtgcaatggtgcaatctcagttcactgcaaccttcacctcccaggttcacgtgattctcctgcctcagcctcccaagtaactggtattataggtgcctgccaccatgcctggctaatttttgtatttttagtagagatgaggtttcaccatgttggccaagttggtcttgaactcctgatctcaagcaatccacccgtctcagcctcccaaagtgctaggattacaggcatgagccactgcacctggccaactttgctattgtaaatggtgctgcagtgaacctacatgtgcatgtatctttactatagaatgatttatattcctttttatattcctttgggtatatacccagtagtgggattgctgggtcaaatggtatttctgcctctaggtctttgaggagttgccacactgtcttccacaatggtttaactaatttagactcccaccaacggtataaaagcattcccttttctcggaaaccttgccagtatctgttttttgactttttaataatagccattctgctggcgtgagatggtatctcattgtagttttgatcagtgatgttgagctttttttcatgttcgttggctggctgcatgtatgtcttctttggagaagagtctgtttatgtcctttgcccacttttgtttttttcttgtaaatttgtttaagttctttgtagactctggatattagacctctgtcagatgaatagattgcaaacattttctcctattctgtaggttgtctgtccactgtgatgatagtttattttgctgtgcagaagctcttgagtttaaatagatcctatttgtcaatttttgctttgttgaaattgcttttggtgtttttgtgatgaaatctttgcctgtgcctatagcctgaggtattgcctagattttcttctagagtttttatagttttgagttttacatttaagtctttaatccatcttgagttaatttttgtatatggtgtgaggaaggggtccagttttaattttctgcatatggctagtcagttctcccagcaccatttattaaatagagagtcctttccctgttgcttgtttttgtcaggtttgttaaagatcggatggttgtaggtgtgtcatcttatttctgagttctctaatctgttccatttgcttgctttttaaaagttttattttcttttttattttaaacatttcttagagaccaaatttcactctgttgtccaggcagcatacagtgacatggaatggtgtgatcataactcactgaaacctctaactcctgggcttagagatcctcccactttagcctcttgagtagctgggactacaggtgtgcaccaccacacctagctaatttttatttatttatctgtagagatggggttttagagagagcagccctattttgcccaggctgctctctaactcctggccccaaatgatcctcccacttctgcctctgaaagtgctgggattactgtcatgagccactgtgcctggttttaaaaagaaagcattgtgcttgctttaaaaaattattgttaaggctgggcgtggtgactcacacctgtaatctcagcactttgggaggccaaggtgggcgcatcacctgaggtcaggagtttgagaccagccttgctagcatggtgaaaccccatgtctactaaaaatacaaaaattaaccgggcatggggcgggcatctgtaatcccagctactcaggaggctgaggcagaagaatcgcctgaacccaggaggtggcggttgcagtgagccaagatcgcacctctgcattccagcctgagtgacagagcaagactctgtctttaaaaaaaaaaaattattgtcaaaaacgatgtattttgtttatagtttatttactataactgaaatcttgccatttttatattttaggatattggtctgaagatacaggttataaatgagggaggaaggaaatcatcttataatggtgtatagactttttagtgatagtaaactgttttacaccttgatattatgttatatgacactttgttttaaatatattcaattaatggctgaaaagttaggttatgctaaaatactgaatttatttgtggtataatccttagcatgatattcaagttttttaactaagtctgattatgtcatctgtgaaaggcagattatgacatagtctacctcattaaggttgttataaaaattgaatggaccaattcagataatgtagaatactatttgatactgccctctatggtggcttaaaaagtattagttaaaatttcttctttgtgtgaaaactcacaataaaatggtttttgctctagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactgtaagttgcaacatatagttcacttgaggtttgcaattcagtattttgttcattccattctagattttgactttgatatgagattattgcttatgctgtaaaacttaagtttaagtggatttgagtcattgttctttatggttagctgtcctgaaaagttaatactaattgaataatgctaatcaattcagttagctatttgagcccttatgtctttggtgctatgatttgttccgttggcaattcaaagtctaatatgatcatttctgcttctaaggtgttggaataataaagtataaaattatagtggtataaatgatctactattacatattttatagtatggagtggactccaaatatgtgtggcatttaaaaatatttttgcacatagcttatgtgaatatttttttcacccagacaaatgtactttttggtaattgttgcattctttttcagaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaaggtaattgaatatttctatatattttacttttttatataaattagcattataggaaagatgtaacattcttctaggaaagagggtgagtaaattatagcctatcctagaagaatgtaagtttaaatgttgttatgttaaataatctttgtcctgagagcatattaaatagaattctccttttgttttctttgatcatttcaccataatgggatatgataggcatcctttcatgggagaggttctcagcctatttcattatagtacttttcagttgattggagttataagttgactgatgatacacacttaattatatccataggaagaggcaatcaccttcaaatgtagtataatgtctatattttagttacttggtgttctgattacaatttggtccaggtttttggtagtttttacatttaaaattataacctgtgcttcttttttttggtgtcatattaacaaaatatctctgaggaatatgaaactacatgggaacaggaaaactatgagaaatatgcatataactttactgttttctctgatgttaatttacttaatttgtttcataatatatgccagcagcacatctctttccacgagagttagtgaatatcaaatgtatttattcatcttgagaaagtattattcgactgtatattgtggagatagaatgatagtaataagtatttatggagtatttaatacatgtcagaaattgagctaaacaattgatatggatcatttcatgcaatcctcacagttacccaatgagataaaggtactcttaattttttttttttttttttgtgatgggagttttgctctgtagcccaggctggagtgcagtggcacgatctcggctcactgcaacctccacctcctgggttcaagcgattctcctgccttagcctcctgagtagctgggattacaggtgtctgccaccaggcctggctaatttttgtatttttagtagaggtggggtttcaccatgttggccaggctggtgtccaactcctggctgcaagtgatccacctgccttggcctcccaaagtgctggaattacaggtgtgaaccaacacgcccagccaaaggtactatttttttgttttgtttcatagataaggaactaaggcagagtgaggttagattaggtaacttgtccaagtcagcatatctgataaatgacagctagaatttaaactaaagcaatctgaacagaaagactgctataagccactatactacatttcctcccagggttgtgtgtccccaataatgagttgatgatattataagaccttagagaaaactaggacttgctttttaatattttatttctaaataaagttggatcacttctcttcattacatataatccatgggagacctaccaggatagaataagattagaatcttttccaatgccttttcttaatacctttaataaatcctgtcatctgggctagagctcctgatgtactaatagcatgttaaaatcagtatacttatttccaggatattagtatgaagaaaaaaattttttttaacatgtctttgggttagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggtaaggaatatgttctatgaggtttttttgtttgtttttcttccttttgcagcttaattataaaattgaagaaatcatatttttggtcattttctggctgctagccatttgtttaaattttaagttggtatttttattttgaaaaggctgatttaaatcacgtggtcacatgcacaagatcatgaacacgagatcacgtttattttcttatagcattatcacaactttgtttacatatttacatatttagggcattaacaacatatattagcattgaaaaatgtggacttttaagtgtttttagtagattttattttttcactgaataaaaatgttgaagtttatttttctctactacttttaaattacatgtatattagaatatgtttgtagctctcctctcaccctgcccctccgactactctttccttaggtcaacaaatgaaacttttcaattctaactgtagtttaatccattattggatagaagggaagtttggaaatatgttctctattttaaatctttccctaccataaatttgtatttgaaatcactttactgtttatctatcttaaaaaaatatgtaaatccacagaattaaattattattttttctttcaactgcccttattcttgtaacagacttaaaggactgttggcaaaatattttaacccatttatgccagaggttgcaaattttttttgtgaaaaatcagactttggtgatgaccttgagcagtaggatataaataacttctacaagcttaccattccaataatggaatactagacataagttcattaagagagatttttatctctggtttctcatttcccattctagtctggctcttttctcactattccatgaaattccttttgtcaggatcaccaacagtcttctgggctattaaatctcatagtcacttctctgtcctatcttattcaacctttcagtatcattcaatacaattggccattctttcctgcgtggcatctgtgataccacattgtcttgattttcttttttgcttcactgttcactcatatttaggcttctttactggctttttccctgtaaattatctactttatcctctaaatgttagaataactcaggactatgtaactggctcttttttctcagtcatcattctctcctttaatgatcttctttgatctttttctttaatatgagttacattttgataatttttagttgaaatttcagtccagactgcctctgagcttggttttataggttaggtcctgggaggaaacagatggcatacacacaaacatttacacagaaatagtttaacaaaggggctacttttagtgacatggcaaggttaagggaaccagcaaggaatgttaaggaacccaggtactacaaaccacagaaaacttaatgccccccttagttctgggaaaggggaagaaatagtgttactagaacctgattgagagccagaaccatgaggggggtcctctcattgtagaggaacatagccactgccagaactacctcaaaacacagacagagcaggaaatatgaataccatactctctcctcctaccctctgttctagtggtatttcctgctgactgaattcagtggaaagccagagggtaagggatcctaagtaatgcagtccggtcagtgtcccaggtacggagcagggcagaaggcggcagagaatggacctgaggatgacagaagatggcaaacagatattcaccttttcatcatctctactctcatgtcttataagcatctcaaacaattccaaatataatatgttcattagaaatctttattttccctttctaatctgtttttctcccagtctttcccatctcagtaatggtaccgctatctaccagttgcatgagacaaaacctgagaagcattcgtgagccctccatttcctttatccttttataattaatgagcaaatcctatcaagtctctccaaaatatatcttttcatttctgccaccaccacccttacacaaataatgatcatctttcttgggacagctgtgaacatctcctaatggttctgtcctttcattcttccctctctacaattaattatttacacagcctttggagtgctctttttacaaactcatatcgttcccctgattaaattccttcaatggttttcattgcccttaacataaaataaaatctgtaaggcatacatgatctgcctacctttctactctcacatggtacaactcttttcttcctttctccctatatttcaacatggtttcctttgtgtttcttaaacatgccaaactttttcctgcttcgagacctaggccctggatggtctctctgcttggaataatctcctggatctttctcattctttagatttcaagagtttcctgagtaccctgtctcgactcccttaccacatttcttgtctatcacaggattgtgtttattttcttatagcattatcacaactttgtttacatacttactacttatttagtgtcttccattcatgctagtctaccttgtaagctaatgagagagaatgactctgcttatcttgtacacctgtacccagtataggattctaggcatacataataagtatttggtgatagataatatattggtaggtagataaagtcaaataattgtttgtctgagtgcaagaactttaatattggaatgttgacagagattgtgtgatccttatctgctttttatttaagcaacataggctagaaccatacaattagtgaattgtggcttaccatgccaaagttgagtctcaacctaaatcagaagtttgcagaacaaaatgcaattttagattttaaaaaccagatgatttcctgtgctaggcaagataaagatttatcctgacatctaatctggagagacttgtaggatacctcactcctctctattatatggtagcacacaccctcctacccttttcttggtaatgcatggaacctgaagatacctaaatcagatgcctcaacatcaagcagtgcaactttcttatggagttcaaaatgctttagttgctactcattcccagctcatttttttttttttttttttttgctcctttcttctgcctgtacataaagacatgaaacaaaagaatattcttctttacagactggtcacattctcagtttgtagtaatatgaacaaattgatttaatacttagctatatactaagttcttagtgaatggtatcttttttttttttttttttttttttttttggaggcaggattttgctctgtcacccaggctggactgcagtggtgcaatctcagcccactgcaacctctgcctccagcgcttaagcaatcttcccacctcagcctcctgagtagctgggaccacaggtgcatgccaccatgcttggctaattttttttgtagagatggggttttgccatgttacccaggctggtctcaaacttctgagctcatgtaatccacctgcctcagcctcccaaattgctgggattataggcgtgagccaccacacctagccaataaatggtatcttatttagcctttacaacaactctatgcagtaggtggttttattattcacattttacaaacttggaagaattaagtaacttatagaagatcacacattaggaagtgtcaaaattaagattcaaacctagatttggctgacttaaagcccatgccctctcctccaggaccttctcttaagaaagtattaacttggccgagcacagtggcttacacctgaaatcccagcactctgagaggccaaagcaggaggattgcttgagcccaggagtttgagaccagcctgggcaacatggcgaaactccatctctacaaaaaatacaaaaaattagctgggcgaggtggtgcgtgcctgtagtcacaggtactcaggaggctgagctgggaggattgcttgagtctaggaggttgaggctgcagtgagtcgtgattgtgccactacacttcagcctaggtgacagagaccctgtcgagagaggaagaaaagaagaggagagaaaagaaaaaagagagagaaaggaggaaagaaagaaatagaaaggaaggaaggaactctaagaaaaaagaggaggaaagaaagaaaaagaaagagggagggagggaggaaggaaggaaggaaccctgtttaagtaaaagaggaagaaagaaagagaaagagggaggaaggaagcaaaggagggaggaatggaagggaaggagggagggaggaaaggagggaggaagaaaggacggacggagggagggaggaaaggagggaggaagaagggatggacggagggagggaggaaaagagggacggagggaggaaggaaggaaggaaggaactaaggaaggaactctgtttacttcaggaaacctaaagcgtcatggatgatgatatctagtctgcaacttttgatgcccatggtcttgtgcctcttttcccctgttacttccagggatattatcccctatgtcagatcattattctggtagaataccttttccttaatcgtacttttctaccatagctctaaatgtcatagaataagggcagtcccttgtctttctctattcttttctttcttcttttcctctccaccccacatcccgacatgaattagatcctgaggatcccaccccagttcactccatgattaaaaaactcatcattttctcattgtactgtactgtttaatcatattttttcgtggtgactataaatcattcctttaaatactacatgtttctttaaatactacatgtgaagatatatgcttttggagaaacttaattaaccaagtgtttatttctaatatgctaatctagttaggtaaaatataaatgacattaattaaataattaaaatgtcaacttaagaaattcaatctgtataaagcttacatattatctgtttttatttcttaggctgattatttacaacccaaattgttgggcattttggctttttttaacatgcagttactgagctctagtgttggcattgaagataagaaaatggtaagtggtgatagttccagagtgctaagatagaattcatacagaatatagataaattctgcatctagctacaaacattcaaagatgagaaataaccaaatatgacattctctattgctgaagaactcatatacgttttttgggagtctaaaaattggaattgtattcgtttcatttctttagtttaggagggatagaacacccaacccaaagtgactaaaaggaacttgtggctgtgttactaaaagcgtaaggatgatgtagctttaggcataacttgattttggactcaaaaaagttctcagagtcagtcttttggctcagattcatctgggttggctctgtacttaagagccagttaatgacctcaatggcttcaagctcacgtcatcacaacatctagtccagcatttgaagagagagactagcaatcactgaaagctcaaacaaaagttgcatcattgagtctccttggtttagattggtctggtgtgggtcatggctcatggtgtttttgaacaccagaaatcttaggttattataatgtaaagcaactttatgtttaaatgcttgtgccacagtgaagtttcattatgactgctgcaacagttggccaccgttggaaattttcgtcctataaattggagtaaaattttagatattgataaaatttctctttctgttgctttccacctctgcagtcagtaagattacaataaaaacaaacaaaaaacacctacgaatggaagcttttatttcagtgtatactctcccctccttttttttttattaaggagccaagaaagacatatgttaccatattaaattttgcaaatttcagcaaccaatgcctgttcttttggtgtcaactagtaaattcaatcccccaaccaactactattccatctacatggcttctttcctattgtttccccaattgctattctaagggagagaatcaccttgaatctaagaaaactacagtttgtcttgtaaaccataaataactaaaatgttttggcatataaagtcgaccagagtttctttaccccttcattataaactggagctgctgataacaggtctggttctgtgtttttcatgtgtttcattttctgagtgtatcattaattatttgttttactaaattcaggacatcttgaatttaatatcattaggacaaaaatttccttaactactgattactaggaagtattccatttactacaaaaattgttatatggtctcaaatttaaatgattttaattcagtttgttttatatatgtgtatggcagtttgggatagatatgaaagaaattaaacaatatgcattatacctttaataaattagaaattgtactgttctagatgaatactgggctaaaataacaaatcaccttcaagggaaaaaacaaaaaagaactcaacttgtatttttcaaatttataattaccacataagacataagcaattggacaaaacaaactggccaacatttattcaatcttttgtattatctgagaatagatgacaccctgatactgggtgggaagcacttgtccttagggctcatctgcttctggcagcatgtttataagctttactctgaagcactacttaactctataggccttgaacagtttgatgtctttgatgaagttaatgggacccaaacatgtcagttctgtgagggtgaagatgatgaccacactgagaactggccttcgattcaaggatgattttcctgaattgtgttgcaggtaaatgactgcctgagtttattaattttttttttttttgcattttccagtagcactaacttgaattcttatctctttgagggaaattgggttcaaataataaataaggtagaaagactatttatttgtatttaaaatagaacatatttacttcttttaaaacattttactatggaagtcttttaacatactgggaaatagaagagttatcaatgaacctacatacctatttcccaactttagcagttatcaacattgctagttttttttaatccacttctacctttttgattgttggttggggtattttagagaagatcccagaatcttatcattgtgcttgtaaatactttagatgtatctaacggatgaggacatttaaaaaataaccttcatgaattattatacttagcaggattaatagaaatatctaatctaaaactcagtccttagtcacatttcctccagttgtctcaaaggtatttttcccaaagacattgtatatattatgttgtatatgaccagagatgtttgtatgtatcagagatgtttttccagagatgtttgtatgtatcatagtttcttgaattagactataaatgaagtttacatatgtgtatttggttgcctggctccttaagtgtctcttgtaaacagcctcatcccttaaattctctactcacacattttacttattttaggctgttaagattttaggatgttggatttggcgaatagctaatttaacttttccctctattttttctttcctccctgtcttttctataaatgggtacttagatatagatgcttgattagatttaggttcaatttattatgataacatacctcataggtgaggctttgtgcttctcttgtggcacagtatgagccacataataatatctggttgtccacttttagtaatggtaagattagacagtaggttttatcaacctgaatccctttattataaaattccccactaatctttcatctgatgattttagcattaattaatgatcattgcctaagtccattatttcattgcagttgatgaaataatgattttctaattttattattccttctgtatttactaggtgggattcttcttaaaacaaaattcctcataaaatttggctagccgggcatgattgtgcgtatctgtagtcccagctgcttaggaagctgaggtggaaggatcatttgaggccaggagtttgagtctagcctgggcaacatagcaggaccttgtctttaaaagcaaaacaaccatagttcatataaagcagttcataaatacttgaatatttccctttagttaatcaatttaggaatataggtttgtgctgtagcaacctccagtgaagtttttttaatatcattttgataacgtagatttttataagtttgattattttttatccattaaagtcactatccttttttattgctgaaattgtcccatcttaagcaagtagaaatcccttcaagttggcatctatgagttttgatatgacctctattaatctcttatagattctctgctttctggcatgacaagatgacctgggcttatcttgaacatttcctgcctctgactcaaaattagtgatttcttcaaggaaacctggctctggttcctttgagcccagattaattccaagcataggcactctttgggcctactgtcattgcttctaagtcttaagtgaatgtagctactagaaaatttttataaagaataggttttagaatcacgtgaagtacttattttctgtgtgcatgtgctaccaatttaacatttagttaggttcacttgtttcagtttctttaaaacttttaagggttgctttttccctctattttatttaatttaaaagttatataaaacatttgcatagtcccaaattcaaatctgtgtaacaaattatagtcagaaatctagattccaatttcgacctctacagatatctatttttattaatttttgtatatccaccctctgtaaaagaataagtaaatgcacacacacatactttttttttattattaattctgccccaaacactgtttttcaccttgcttttttgacttcacataatttggacatcactttatttgaatatatagcactgatctttattccatgtttaaagctgccttttaatctattgtttgtatatatcatgtgtcttcaactaattactgattgatagagctttacaaataataaaagtaattggacttcatttctatttgttttttcacatagagcttgggactgctttgttcgctgcctggatcatgcttgtctgggctcccttctcagtcatgtaatagtagctttgttacctcttatacacatccagcctaaagaaactgcagctatcttccactacctcataattgaaaacaggtattgtaactgaaattaatagtaaaataataactttttaaactgtatttttatgtctcaaaattactgatggtaatgtggaaactgtcacttttttgaatttcagggtttatcaataaacaaaagtaattggcatgtaattacatattgaaatgatgctatttcagttgtggcattgcttctattataattatttccaaagctcactaataggtcaccagttaaaaattacttttcattaattctgtaaatgtgtaacctaatttacctttcttttcacagtcaaaaggcagatagttgaatagcatgagaaaggttaggagagatacctactttctgcagcttaccttagttgaaacccttattacctcattgcgttaagctttgaaccagcctctcttcctttaagctttcatcacttttcttgatattgttactagaactgtgttttaaaaatatctctttattggtgtcattccagcatacaaaggcattctgagattctccatttcctaattgataaattccaaattgcttagcttgatattgaaggctttctaaaaatgtggccacagactatttcttactatcttcccccataatttttcaaaacaggcattaggctatagccagtgtggattactattgacagaacatgcattattctttcccatttgtatttttgattcaggctgctttttagactgggatgtctttttatatatttaattttttttctgtgattttacttaatgttgtatataatcattcctttgcttgtgaaaagttgggattgaagtactacttatttacctactcacccatatgctattgctggtccctttagtcagttgcagtaactgtctaatgagggagaaatcatagaagaaggaaaagttaatgtgtttttatttagttaaaatacttttatttttgatatttttatattttgtgcatgataaaacaacaaaatcactaatttagattttgggactacttttcaagtaccttttaaatttttttgtacatagtcatgtctttgctgtttattgcagaagtgtcatttctctacctttctcataatcataagaaaaatcctgaccaggcatggtggctcatgccaacaataccaatactttgggaggacaaggctggaggattgcttgaggccaggagcctgggcaacatagtgagaacctcatctctacaaaaaatacagaaacatttaaaaaaaaaaaagcaaaaagagcctgtaatcctagctactgcaggctgaggcaggaagattgtttgaacccaggagtttgaggctgcagtgagttatgatcatgctgcaagatagaagaccttaagcttgctgaatgaaggcactactttggctttgtttattgttccatccccagtgactagcagagtgcttagcatgtagtagcacatagtagttatttaatatatatttattgcatgagttaatgaagactaggatttagaaatgcttatatttggacccagaaagattagagcatttattatattagaaggaaattaaaaattatagccctgacaaggattatttatgtatttttttctataattcttcatgataatttgtatattgaggtagtctttgtctgtctattgctacattccaaatcactccaaaacctagtatcttaaaacaatgagcatttttatttgctcataattttgcaatctggactgtgctcagctggtcagttctactggtcttacaagtggtcactgatgtggccacattcagggggcaggtagactgggctgggccctctctcattccgtgtagtctcacagtctgtctctctgtaccacggtctgtccatgttggtggcaacacttcttacgtagtgactcagggctctccagaacacacaaatggaaacttgcaggcatttttaacaggccccaaattggcacagtatatcttctgccacagtctatttgctaaagcaagtcacacactcagcccagcttgaagaggaagggactgtatatatgggtttgtatgctgagaagcatggtttattgtagcactattatagagtgattttcatagctttggtcattttccactaataatttagctgagcatcttagacatagttagaaaatactttgcagctcagtaatcaactagcacttttaattatgaattaaattggccttagtttcaacttttactttacatttttttagtattcatattcttggcaaataattctttttattccaactaactattagggatgctgtgcaagattttcttcatgaaatatattttttacctgatcatccagaattaaaaaagataaaagccgttctccaggaatacagaaaggtatttaatttttaatttgtggtttaggagatcattaatacagaattgttcccaagttccaatacatgaaataaagatcctttaggatcatatctagggataatatagtcctattctgatagctaattcctggtgagtagataatgctaccatgaatccatgacttttggagggaagttttagcatttagattaaatatgtaacaccattagatagaacagagagcaaaaaatacaattcttatgcctttactacccagaccaaagtgtccttacttattgtcccaaaaagaagcgctaccacagcggcacaccctaagagaagaaaggaaagctgtgggatgattctagttttgttgtgctacaaaccatgatatagaaatgtcagatgtgaatgattcctgagatttagaaggggaataatttataattccagcatcttaaatcttagtgagctctctaaaattatgaagatgttagtggtgatttcatagaacttctgggtagaaagtgggacacctgaccttaggtgtcaccttgggtagtgaaaggaattgaattacctatataatccatagacctggttcaaagctattatgtagccctttgtaaattaagggaaacttgtacttcctgtcaagaagtacttattttagagaagtaaattcttacttagttgggataaaatttttctccaggtctaacagttttacaatgaaatccctttccctcagaattactaaaaatgatttgtgctgtacaaaggaaggaatggaaatttcattactttaaaaaattggtttggtatagtttaatggtaactatatagagaattcaggcctttggaaatggttgttaaaatagttgattaataagttctgtctctctgtgctttgtatataggagacctctgagagcactgatcttcagacaactcttcagctctctatgaaggccattcaacatgaaaatgtcgatgttcgtattcatgctcttacaagcttgaaggaaaccttgtataaaaatcaggtatgctaatatgatataattaaaaatgtataacaaagaaagattggaggcttaaagaaaagatgacaaaatgacatttttgtttgagatttagtgaaagaagaaatttttattttacctgaattatcagatctgactgagaattaggaatccatgagatgccctttgagcttgaatcttagggatttgcagtttttgttgtttttgaaggatcatgatttgatggttatattttaggttactgcatcttcgtaagtaaacatgtatataattgtataatacagcagcagtttatgtaagtcttctcacatatttcctatggatatatgtcatatgaaatgtcagcaattttactattgtacattttgactgaattaacgttagttttaatgaagctaaatctttaagtttactttttcaaggggtgagtgaactttattcttttctttggcaacataatgtagattatccctaaacttgatgatagtgagaactggtatttaaaataccagatcactgtatatgaataaattggaaaaaatttaacggaattactcatttttgcatatctagaacccatatggtaagatatgagagcctaagaccctcatgaattttgggattaccattctataatggaagggttatatttccttccattaatagaagcaagcacttacttaggacaaaagatatacgtgatggtaatgagcacatttttctggggcagtgagtttgtataaccaatgtgggtagcagccagtgtggagatgatcccaacagaggggaggagccttgaatctcctctaggttaagtgttgtgccttcctgactatagatgtgcattatcaacgttacagcctctattcctgctctaaactacaatgaaactaccctgtgcttgcccctagccccatacctttacctggttttcaggtaactcaaaggacttttagccttttaatttaatacagagatttatgaatcacaaaggttttctcctctttgcatagaggttttctagtttaggttatttccaagcagatggcacagtcattgtctaacataaggaaacttcacctcaatcatcacttcctagatataaataactaaatctgagaattcaagaagatttcttacagtcttaaggaaagctgcagctgcctcactttgcctcctggatcacagaagataaatcatatgtggcaacttccttacaggattccttcaatgtaaagccccaatgctaatagattacctagacagaataagaagggaagtgtacttgtaggagtcttgagtactctgattaagatataatagccgtatattattatgggatttttttaaagtaagtatttaatgtagtttagcatctataactggataaatttatggcaggctggtaagaaaaactaaaggcaaggaagattggaagatccatgaggaggtaagaaaagaataaagatccagaaacacgtcttcctaaccatactccagcaggcactggcccaaaacacctaggaataaagagagaaggaaatgggttttttcccaactgtggcaagaagatagcattaaagttgaatacaattgaattaagacttccaatagtactgtccaaaggacctttctgtgaggatgaaaatattctatatctatactcttcagcagtagccactagccacatgtggctctcttgagcacttgaaatatatgctcaaacattatgttctgagtaacagaatttttaattctatttaattttgctaatttaaatttatttacttatttacttttagaggcagggtctctccagtacaggggtgtgatgatagctccctgcagcctgaaactcctgggctcaagcaattctcccacttcagcctcctgagtagctaagattacaggtgtgtgccaccatgctcacctaatttttttttttaagagatggggtcttgctatgttgcccaggctggtcttgaactcctggcctcatgcagtccccttgcctgggcctctgggagtactggtattacaggtgtgagccactctacctggcctaatttaaatttaaatagccacatgtggatagtagctattgtattggacagtgcagctctacaagttggttgaacctacaggaataccaccagagcatgaaactggcataagataagaggatgagaggccagagtctttgtagtcagtactcttaagagtccatgagacaacagatgcaaaagattctgttttagaatttaaaatttagccacagggagaggaaaagatactttaagagtggattgaaaggaggtttttatttaaaaatacacctgaagttgtggtaggagtggctaaacaaatgattgggtgtaatgtagcaacaaagcaaattccaagaggtggtgataggaaagttaataagatgatcgctggtatagcattagatacttaactattttttatggaatgaccctgcaaaagccctgtactgatgggtagtcccagacagtcattgacattgaagagatgacaccttctacttatttttaaggaggaatatatatttttgaaggaatagaagacttctaagctcagtggatggcagaaaatgatttctatgtagaaaagtcagactagagatcaaattaagaaaccatataattggtttctgaagattgatactagtcaggaatccatttgataaaatcccaaaaagataactttgtaagaagccaaaataaacttttatggcaatgcagaattctaataaaatgacatttactaacgtttacacataagagaagaggctattgaaaataaaactgggaggtggagccaagatggccaaataggaacagctccagtctacagctcccagcgtgagtgacgcagaagatgggtgatttctgcatttccaactgaggtaccgggttcatctcactggggagtgtcagacagtgggtgcaggacagtgggtgcagcccaccgagcatgagccgaagcagggcacttctcaaaagaagacatttatgcagccaaaaaacacatgaaaaaatgctcatcctcactggccatcagagaaatgcaaatcaaaaccacaatgagataccatctcacaccagttagaatggtgatcattaaaaagtcaggaaacaacaggtgctggagaggatgtggggaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacatatgtttattgcagcactattcacaatagcaaagacttggaaccaacccaaatgtccaagaatgatagactgaattaagaaaatgtggcacatataccccatggaatactatgcagccataaaaaaggatgagttcatgtcctttgtagggacatggatgaagctggaaaccatcattctcagcaaactatttcaaggacaaaaaacgaaacaccgcatgttctcactcattggtgggaattgaacaatgagaacacatggacacaggaaggggaacatcacacactggggcctgttgtggggtgaggggctgggggagggatagcattaggagatatacctaatgttaaatgacgagttaatgggtgcagcacaccaacatggcacatgtatacatatgtaacaaacctgcacgttgtgtacaagtaccctaaaacttaaagtataataataaaaataaaataaaataaaataaaataaaactgctagagactttcaggttgtcttaggataatggtggatgcctacatctgaatttctgtgtagcccctgaaatatcataaagagtgtcaagcagagcaattgaaaccacacataatttacaccttcaacagaactttgagacagaatattatgaacttcaaattacttgtaactaacagagatatctgtggagctcatatcttaaccttgtatggtgttgagagcgggtacgttctgatgagactgtataaaaaaagaagaaaatgaagaataggaactaagaattgatggagcaaagagaaaatcaccaacagaaagagagtcatactcttaagtgcaacattactgaaaataagtccaggatgtggtatgtcagactactggctacagggaaggtacttgaaagtatgcccaacgtttgtagtctctgaaaatcagtttcttgggagtagtaaaagaagaggagaggagaggcactcttcagagactatggcataaacagaaagaagaaagtaagagggagaattttaagggtcctgcagaagtaaaagaaatgtacaaaatcagagatgaaccaaatcctccccctgctaccagaaaaagaaaaaaaagctattcatgaagaaaactgcacttcactatgctgacgtggatactcatgaaagagaaatcctgaagccactacagaatgcttactgcagatagctgttatggagggttttctagtttagaaatttcacaatatgtgtagaaaaaatatatgtatgcaaggttcctgtaagacaaaaatagaaaatgaaaataaagtctgtgaattgatgacagttcctcctcaaaaccaaccataacatggaagaagattgaacttagcagtataactttaattgaatattttaaacaatcattttcagatataaaaaaagttgcatgaaaaatttaaaaaacaagagaaataaaaaccaagatgaaacgagggtgattgaacttaggaaagaaattgaaatgaagattaaattacaagaactacaggggagaatatatttgactaaacatttagcaaggggcattgaataaaggtataaaaaacagaagaaaaatgagataaaggagtaaaatagataaaggagtaaaaaggagtaaaaagaaaaagtagttgaaatggaagattggcaaagatttcacctgcaaataattgatgtctctgaagaataaaaccaaaacaagagaacagaattaatatttaaaattataatccaagaaagctttctggaaataaaagacctaatctacatattgaaaagacttgtatcctggagaaaattgacccaggataattaactctgagacatatcctagactttaataataaaaagtcttcaaagcttcctggccaaaaaattttttttcaaaaaattacttgcaaggagaaaaaaaagtagattggtatcagaattctcagtaggaatgtacagagtgggcctagaaaatagcagcatttttttaaaatgtcaaaaaatgtcataaagtatgagtcaagaaagagtcaagctgtccttagagtatcatgtatgagaacacggttttaaacctacaagaattgaagtaatatggttttcacaagtgatcccttcctaagagatgtattagaggatgagcttcattaagtcaagagatgactgggcagactttggcaaaaggtctgatggttactgtttatgtatttaacgaaatatataagactaaaacaacaatagggcaagtgtgggataattatatgtaaatgttatattctaataaactagaaataatgcaatttttttaaatgagagaagggggagagtaaggagtaagtaagataagctcagtaattgttgcataggcaataactggaagtcaaaatataccattttacaccggcaaactagttatagaaagtcaaataaggaaaagagggagtgtaggtatttcaaaaaattaccttaatttttattttacctttaaggtaaataatatttcacctttaattaatattaaaggtattaatatattggataggctgggcacggtagctcacgcctgtaatcccagcactttgggaggccaaggcaggcagatcacgaggtcaggagttcaagaccagcctgaccaacatggtgaaacgctgtctctactaaaaatacaaaaattaaccaggcatgatggcgcacctgtaatcccagctgctcaggaggctgaagcaggagaatcgcttgaacccgggaggcagaggttgcagtgagccgagattgcgccactgcactccagcctgggtgacacagtgagactctgcctcaaaaaaaaaaaaaaaaaaaaaatatatatatatatatatatatatatgataattccagaacaaaagtataaactgtcatccttacccaaataaatgattttttaaacacgaaacaggatagagggaagaaagcactaattatagtatactgtattataattataatccattgtattataataaaaaatctgacagaattgtagccaagcatctgagtcacattaataagtgtgaacaaccttaaaattaaaaaatttacaaattggcttacaaagtaagaaacaactctctaccacatgcaagatacgtacctaaagtgattcagaaaggccaaaaataaagggataagcaaaaattatccagataagtggaaagtataagaaagcaggaattctcattctgccaccaaacaaaatagaactgaagctgaaaagcattaaatatgaccaaaatggatactttttaatgcttaatgccataattcataaggaagatttaatagttatgaatatgctccaaataacacaccagccaccttgataaagccaaaataagaagcttaagaagatatatatagaaactcaatcagaggagactaccatgttattctcagtataaaataagttagtagataaatacgtagaagatctaaataacataataaagtagctattgtgaatatatgtcagacgttacaccttgataatagaagcatactttaaagagcagatagaacattcataaaaattgattattgtattagttggatctttgtgttagtttgctagggctgctataacaaagtactacaaactgaatgactttaaacaacagaaacagaaatttattgtctcacagctcccatgggctagaagtttgagatcaaggtggtggcagggttggttccttttgagagcttctggtggtttgctggcaacctttggtattcttgaataaacagatccatagagatagaaagtagattaatggttgcctagggttaggaggtttgggggaaatggggagtgattgctgatgggtacagattccttttgagatggtaaaaatgttctgaaattaaatagaagtgatggttgcacttgtgatatacttcattatactaaaacttgtgaatatactaaagaccattcatttgtacaccttagaagagttaattttatagtatgtgaaacaaatattttattaaaactatttaagaaaagatagtacaggaagaaaataataaaaataaaagcagaaatatagagaacagaaagcagtaaaattaattaatgagtaaaaatgctagcaaaaaactagcgaaattggtaaatgtcaaatatgtaaataataaactgttgaaacatagaaggtatttaaaaatcacaagagactactttgtacccttttacacaaataaatttgtaaacatgtatacttttcctggaatatatagtgtatcaaaatgaactctagctgaaatagaaagcttaaaagattagtttctgtaggagaaatagagaatattataaaagaacttcatccataggaaagcaccaggcccagataaggggatttttaaatcaaattttcacaaactaaatagtctcagtggtgtttaaattgtcctggagtataggaaatgaaagaaaacttccatttttaaaaaagcggcaatatataacagtgttcagtagaccgaaaaaagatagcatgaaacaaaaaattaaagattatcatattaatatcagtgtaaaaatttataaatgaaatattatcaaacaaatcaatttcacattaagaaaacaccccatgctgggtgtagtggctcatgcctgtaatcccaacactttgggaggccaaggcagatggattgcttgagcccaagggttcgagaccagcctgagcaatatagcaagaccccatctctacaaaaaatacaaaaattagccaggcatggtggcacatgcctaaagtccaagctacttggaggttgaggtgggaggatcaccttggcctggggagtttgaggctgcagtgagccaagatcatgccactgcattccagccagggcaacagagcgggaccctgtctcaaaaaaaaaaaaacaaaaacaaacccacaataccccatgaccagttgcattttattccagtattgcaaagatggttaatacttagcaatccacgaatgtaattcactatattaatagatctaaagagaaaatcatgctattatttccatagatgccgaatagactttgacacatttcatcacctacttcaaatgaaaacactcaagaaaacagaaattgatgaatattatcttaatgtatatgtgtacatatatgtatgcatgtttatatatgtactatgtatatatatacatagtacatatatacacatacttaatgggaaacaagaaacattcccactgaaagcaaggtttcctattatctgcactatttagcgttcacttggaggtattggctaaggaatttagggaaaaaagcaatcagacataaaagttggaaaagatgtaaaactatatttacagatgatatgataatcagagacataagaattggaaaagatgtaaaattatctccatttcttatgctaatatacttcggaaattatagagaattactgataaaactaacttgaccacagatgaattcagtaaaataggggatataaaattaacataaaaattaataattttcatatgacaagtggtaactaggtagaaatttttttggaataccccatttacaatagcaacaggaaaacaatatagttgagtataaacttaacaagaaatgcatacaccaacaaaagaaaaattttaaaatgcttctgaaagacacaaaagggtaatagatttaactaaatggaaaccatcactgttttagtctgtttgctttgctgtaaaggaattatagtaaattaccctgaggctgggtaatttattaaaaagaagaggtttatttggcttatggttctgcaacctatacaagaagcatggtgccagcatctgcttctggtgagggtttcagcaagcctgagcctttactcatagccaaaggggaaggggagttggcatatcacatggtgagagagggagcaagaaagcaatgggaggagtgccatactctcaaataaccagttatcacttgaactaatggagtccagctcacacctgaactaatagagaaagaactcacttattatcacagggatggcaccaagccattcatgagggatccacccatgtgacccaaacacctgccaccagatctcacctccaacactgggggtcacatttcaatatgagatttggaatggacagatacctaagctatatcaatcccttattattgggtaggttgatgttataacgatttcagttctccttaggttaattaatggaatgcaatcccaatgaaaatgtcaccaaagttgttttttttttaactgtaggaggtttataataatgctcatatggaaaaataaaacatgtaaaaaatagctagtaaactccccctgtaaaaaaaaaggttatgagaatatagtagcccaaccaaacattaatatactttgtagccactacagttataacaaagaggtaactagtatatgaataaccagaccagtgggaaacaataggaggtctagaaatagacccaagtacatatggacatttagtatatgataaaaagtgacacttcttatctgagttttacttttaactgattaccagggtgtgtatgtgtgggggtggggaggcggtctttacagctgaattaacctgtaatgttatttaagaaatcagctattgaagattctggataagattaaatgtcttttcgtttttcttttgaaatgtattacagtaatttgtattactcattacagttctaacatggagtttgagatgctcctatacacttgacttgtgctagaaagaaaataatataaatgaagtagctttaaagtgatcacacaagtgcaaggtctaaatcttcactggcttgagaattgtttcttcttacttaacattttattcattacagcatcctgaagagatagctgaaaaaagactatttgaattgacatatttatcattaggctacctctttcttcctccctcttttccatcctcacagaacccttttttatatcttttttccttctttactagttgttatacacttttcaaacttcttgttttaacctaatagttgctcctccacttatctactgaaatatctgtccactgtcctttaaaagttactctgtgttttttcttattcattgcttctttgccgtacaagtatatttgttattgtacatatcatatgatattttagttatttgtctgttttcctcttagactgtgaacttgttaagacttgttttactgattttttgtatattgataaaatgcacagtaactgcttgtttaatggattaatgatcaaagactttcagacatttaatgattctaattgtacaggacatattgttgaactatattatgtgaactcatcaaaaactagctgaaaaaattgcagatacagaaatttaattttgtcaatatttatgttagatattccttaatatttttaagcttcctagctcaggaaaacatactagtttgtagaaattacgtataaattttctttctacttttattttaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtggtaagtagtggaaatttggaatgacaaaagagttctctgtcctattgaggtttatatatttcatttacaaagaactattcagcttatccttaataaaagcttcacctagaaccagacaatcagttaacttctgagtttatttcttttactattgcagaaacctttagccaaaagcaataaagtttgaaccccatctagggtgttatattcttgtaaataaagcttcctaatataataatgacaatacttaaagcctaatcaattatttaaatattactttttaaacattattgctagtgtttccatggataactagtttccaggatattacagtagtaatgttttgtagtcaaatgagtttgggaactccatatagaacaaaattaaatgtgaccttttaaaaaaaatgtgacttttaatgtatctgtgtgcattgtgaatctctaagactatatctccaagagttatactatatgcgtatattaaaattattccttagaggttctcagatgactcttgggctctacagaatgcaacgtaggagatgctatgtatacattttgtgtttttttttggacggagtctcgctctgtcacccaggctggagtgcagtggtgcgatcttggcttactgcaacctctgcctcctggattcaagcgattgtcctgcctcagcctcccgagtagctgggattacaggcgtgcaccaccacgcctggctaatttttgtatttttagtagagatgggctttcaccatattggccagtctggtcttgaactcctgacctcatgatccgctctccttggcctcccagaatgctggaattagagccattagccaccatgcctggcctacattttgctttttaagggttaaaaaacaaacaatgcaaattgtcagagatatgcaaaagttgaataattttttgtacaccttagaaatagcctaaaaagctttacattttggctttttagctacagattatattgtagtcttgataccaaacttagtttgaacctcactgtcttttcctttgtctaagttaaattcacttacgcagttaagttaaattcaccatggaaaaagcagtacacctaagaaaatttatagcagttatcctggaattttcttttttttttttctgattgagactggagtagaagattcaagctttgcctatggattattgatggagctaacaagagcttaccttgcgtatgctgataatagccgagctcaagattcagctgcctatgccattcaggtaagagtggatatagtcattactggctttaaattgtttaattcaaataagaacgttgtaaattctatacttgtgaaactcctttttgttttaattctcacttttatcaaagttatacaagttcatgataaacattttagagtacagaagcatacctcttaaccaattattataggtatagttactttcaaaatttttgtatgtatatacaaatatatactactgcctcagctttgtgacttaaatgagttacttaaatcattctaggcattgaaataaatgtcctaaggatgttcacagctctaaaactataaaattctgtttatttttctatgtacaagcataactcagagatagtaggggttcagttccagaccaccacaataaagcaagtatctctataaagcaagttacatgaattcttcagtttcccagtgcatattaacattatgtttacactatactatagtctgtcaggtgtgcaatagcattatgtctaaaaaccaatgtaaatgcctttatttaaaaaatactttgttactaaaaaatgctaaccatcttctgagccttcgcaagtcataatggttttgctggtggaagattttgcctcaatgttgatgatgctgattaattaccgtggtggttgctgaaggttggaatggctgtggcaatttcttaaaaaaatcagacaacgaagtttgccacatcagttgcctttcatgaaaggtttctctgtagcctgtgatgctgtttgataccattttccccacagtagaacttctttcaaaatttgaatgagtcctctcaaaccttgccactgcttaatcaactaagtttatgtaatgttctaaatccttcgttgtcacctgaacagtgttcacagcattttgagtggaaccacagtagattccatctccagaaaccactttctttgcttataaaaagcaactcctcgtccattcaggttttatcatgagaaggcagtaattcagtcctatcttcaggctccacttctaactctagttttcttgctgtttttatcacatctctagttacttcctccactgaaattttgagcctctcagagttatccaggaggggttggaatcaacttctttcaaactcctgttaatgttgatagatattttgacttctcatgaatcatgaacgttcttaatgatatctagaatagtgaattctttccagaaggttttcagtttactctgcccagatccatcagaggaattactatctgtggccgctataaccttataaaatgtatttcttaagtaataaaacttgaaagtcaaaattaccccttgatacacgggctgcaaaatggatgttgtgttagcaggcacgaaaacaacattaatatccttgtatagctccatcagagctcccaggtgacaggtacattgtcaatgagcagtaatatttggaaaggaatcttttattgtgaccagtaggtctcaacagtgagcttaaaatattcagtaaaccatgctgtaaacagatgtgttgtcattcaggctttgttgctgcatttatagagcacaggcagagtagatttcacataattttttatttttaaattttttttacttttattgttctaattttcaatttttatgggtatatagtagacgcatatatttagatttagcctaattcctaacagccctaggatgtatggaatcgtcaatgagcattggcttcaatttaaagtcaccaattgcattagcccttaacaagagagttattaacctgtcctttgaagctttgaagccaggcattgacttctcctctctagctgtgaaagtcctggatagcatcttcttccaacagaatagaatgattttagctagatcttctggataacttgctgcagcttctctatcaatagttgcttcttcaccttacacttttatgttatagagacagcttcttttccttaaacctcatgaagcaacctctgtttgcttcaaactttttgggtttttttttgttttttaagaagcgccccttgagttgtatcacttcaaactttttttctgcaacttattctcctctctcagatttcatagaattggagagaactagggcttttctttggattaggctttggcttaagggaatgttgtggctagtttgatcttttatccagaccactaaaactttctctatatcagaaataagactgtttctctttcttatatttgatgtattcattggagtaacacttttaatttccttcaagaactttttctttgcatttatacttggctgttaggtgcaagacacctagcttttggcttgtctaggtttttgacatgccttcttcactaggcttagtcatttctagcttttgatttaaagtgagagatgtgcgattcctcctttcatatgtatacttagaggccactgtagggtcattaattggcctaatttcaatattcttatgtctttggaaatatgaagtcccaaagagagtgagggggatggaacggctggtcagaacacacaccacatttatcgattaggttcactgtcttatatgggcacagtttgtggagccccaaagcaattacaacagtaacatcaaagatcactgatcatatatcactataacagatatagtaataatgaaaaagtttgaaatattttgagaattaccgaaatgcgacatagagacatgaagtgagcatatgttgttgggaaaatggcactgatagatttactgcatgcatagtggccacaaaccttctatttctaaaaaaacaaacagacaaaaaaaacagcatccatgaagcataaataaagcgaagtgcaataaaatgagttatggctgtatttttataactaagatatgtagaacattgacgaatataaagcgttatctgcttcactgtggacttacaaatgtaaaatatgtatttgtaggagttgctttctatttatgactgtagagagatggagaccaacggcccaggtcaccaattgtggaggagatttcctgagcatgttcgggaaatactagaacctcatctaaataccaggtatgtaggcttatttaatgtattttcataaaattgtttttaattatataaaaataatgcgatttttttggccgggtgcagtggctcacgcctgtaatcccagcactttgggaggctgaggcgggcggatcacgaggtcaggagttcgagatcagcctgaccaacatggtgaaacgccatctctactaaaaatacaaaaattagccgggcgtggtggtgcacatctgtaatcccagctacttgggaggctggggcaggagaatcacttgaacccaggaggcagaggttgcagtgagccgagattgtgccattgcactacagcctgggtgacagagcgagactttgtttggaaaaaaaaaaaaaaattaatgtgatttttgatatagttttttaacattaaaagtgttttagtatctcctcatgtatatttttcactatgatttatgcttataatttgtctagatgagaagtgcagtctgctcattgggttaaattctacaactttaaatattcagataaatttattgaagttaaaaggattgatttttttaaaagttcaatggtcggtagtaaattgaaagaatatactttaagctgaatgtgagttgaattctttgataggtataagtaatacagaaatttaaagtttaaagctagtcagaaagcctttagtaggcccaattaaagattttcattactcccaatttctcctcatgaatatattttcaccctctgcttttaaaaaaatgtatttaatctcttaaaaaatttaaatgactttgttaggactgacgaaatatgcaagatgacatgcaaatacatgaagcattttatatgaaaaaaatccatacaactataaattatttctatttagaaactactttttggtaccctaggtacacatgcatattagatacttgactttggacaaataacttctttgaaccttagaaagtgcctagacttatactaacagtctttataaaagcccagaggtatgcatatttatttcctagataattttttatacttagaaatcttttaaacatcattttatgtcttatgactagcattattaaagaagtgattatttagcattattattattagccttattaaagaagaattattactgttattattattatttttgagacagagtctcactctgttgcccaggctggagtgcagtgatgcggtatcagctcactgcagcctctacctcctgggttcaagtgattctcctgcctcagtctcccaagtagctgggattacaggcgtgcaccgccatgcctggctactttttgtatttttagtagagatgaagtttcatcatattggccaggctggtctcctggccttaagtgatctgcctgtctgggcttcccaaagtgctgggattgcaggcatgagccatcacacctggccactattagcattatttaaaaagtaaagttaaagactaaagttaaaatttggattttcatttttgaggactccatacttcccccattttcttagtctgtattttgtatagcacctgtagatgtcaaagaatttctgtaatctactggaaagtttatgacctttgtagtcacacaggcttaggtttgattgttggctttgcatttgctagctctgaagtcttgggcaagttatttaacatttccaggttttaattttttaattttgaaaacatggataattttacccactttgtatgattattgttaggaataaaggagataatattaaaagtacttagcaaagtgcctgatatttagttgacactcaataataaatgcttattcaatcctagcttgcttaataagttctttgtttttggggggagaatttgtgaggttggctatcatatacttcataagaagtagaagccaacatttctgcctacttgtcatgtttttcataggaagcaacttttaagtggtcttttaaaagtagatcttaacaaagcaatggaaattcttttggtctttagcttttatacctgagcagttagaataacctctcgaatggttcctcaatgatggaagttaggagatttacctagttgggatctgcttattgaaattggagccacataaaattaagaggttgatagagtgcgttttcaatagcgttgattcccttttgtatgaaaaactaaaataccaggttagcctgtagctcaattttatagcttggactgcttgatatttactccagaggacctagggaaatatggaatttcttaaaagcatattcatatttttgctgcctttaagttatactccctactttatgttttttttttttttaatttgggctctttatatataatcactaaatctggattaaaggatggctgtatttgggagactgaaatttagaaccagatagaacaactgcagttcaaaatcaccatagaaataactttaggagaaaacatcaggttatgactaggcagagcctggcttgtatcccagtatcagtagttttctagctaagtttactataaatttgataaaaatcatccagagaactatacgcgtgatgattcaaaatagggatttgaattttttctcctggtttagtgtgatggttaactgagagattattggatttttcaactgttagaaacttggaatacagtgaaatatgtatatatatatatatatatatattatttgggtataagactttgggtatagggcatttgttatttcctaagcttttattggtgatttgaaagaaacccatgccattcaaaaaaatcctacacacaggtagccgtaagatgagagctgtgtgaacatgtttaaatgttaatgctgaggaacaaatagaaagggtcatgttgaagtaatgtgagagagaagtgatagttggtgtagtaaggaccccaaggagcatccggaatgggagagccgtggcccttatagggaattatacttagaaggaatagatctctttttttgcaatagggaaagataaaataatggatggaacacagctaagtttacagatttcattgcgggaagcaatgattttgtttttactctgtgaagtaggaggtataggagatgacctcattggctgaaagtggcaatggagttggtgtaggtgactttaggagggtggtgatggtttgaaataatcactggaaaacagaagagagccaataatgaaaacgtagaaggaattctgtaactttagcggcccactgactttgaagactaagaatacatagtagtactaatcttataagtgggttagtgattttcctgtatcagtgcagtagcctgagtatcatttcagtaaagacaaatatttagactgattcaaggttgggaggttagcagatgaataccgctggaaaagacagtgtggcaatggagtgggtagaggatattaccaagagaatgctagaagtgaaggaccatacagactaagatggttgtggaaagaggcaaagagacaggggtgtcatagatcaggagagcttagcagggtcacggaacagaagatctcaacaagagagaatgggtgtgctggaataactgggtgaaaaaactggaaatttaggaaactatgaccatacaatgagatgtctaaataattgatttcaaagtgaagaaattctttgaattagcatgggagccctgataattcctgagccctgataagtagagaagaaagtcattggaaacttctgagcttgattaagtgctccagctagacactgaagtcacccaggatgataataacactgggaagaaagaaaaccctgagcagtgttctaaagttatcaatgagtttggtaatcagtgtgttgcatagttacccataatgaggagtagaaaatggtagtatacctgggtggcttgaacttcaaaggaacaggtttttcttatataagaagagagttggaaggatctgaggaagaggagggggcagactcaaatccttagaagtactttaggtgtccaagaatgacctacttcacccctaagaaggatactggaaaaaggtaagcagattgcagtaaaggcaaggcagtactgaggtagtcaactgaaggagttgctgtaatttactaaaattctaaacaggtggatttatctttttaataaacaaattttcaaaattacagatacaagagttctcagaagtcaaccgattggtctggagtaaagaagccaatttacttaagtaaattgggtagtaactttgcagaatggtcagcatcttgggcaggttatcttattacaaaggtaagaaaccctgttcagtttgttaactgaatggaaattctaaaggaaaccagaacatctatctgaatgcctagcacacacaataatcattgaagtatttgtgctgataatcatagaaatttttgaagaaaatgttaactaatagagaataataatttctctgtagttactaataatagcttctgagtgaaaagtaattgttttaccaagaaaattactatggtcttaatgtgtgtgtaaaattacatttattccttttatattgtaaaataatactatgtaaaaggatgtaaatgctatgtcagagttttttacataataaaaagacattcaataaagagatatattatactctaatagcatttctaaaagaagttatattatctgaactttctctaaaataaaaataaagatttttacaatgaattttcatagaaaaacaggtatatttctatttccttaatgagaaatttttacatgctggatagacaaaaggtactctgtgttccaagaaaatgtttacagtatatttaaaatttacaatttttgtttttaatttacctttctttttttttttttttttttttgtgacggagtcttgctcttgccacccagccggagtgcagtggtgcgatctcggctcactgtaagtctccgcctaccgggttcaagtgattctcccgcctcagcctcctgagtagctgggattacaggcatgagtcatcacacccggctaatctttgtatttttttttttttttcgagacagagtctcactctgtcgcccaggctggagtgcagtggcgcgatctcagctcactgcaagctccgcctcccgggttcatgccattctcctgcctcagcctcccaagtggctgggattacaggtgcccaccaccacgcccggctaatttttttgtatttttttagtagagacggggtttcaccgtgttagccaggatggtctcgatctcctgacctcaggtgatctgcccgcctctgcccctcaaagtactggtattacaggcgtgagccaccgtgccccacctttaattaacatttctgttagtgttttaaaatatcattatactaattcgtagttagtaacttcaagacattttctttttttttgagacggaatctcgctctgtcactcaggctggagtgcagtctcggctcactgcaacctccgcctcccgggtttaagtggttctcctgcctcagcctcccgagtatctggaactacaggcacccgccaccataccagctaatttttgtgtgtgttttttttgtagagactgggtttcaccatgttggccaggatggtctcgatctcttgacctcgtgatcctcccaccttggcctcccaaagtgctgggattacaggcgtgagccaccatgcccggctgacattttctttttttaatgaatatactgaaaatataatgtgtgaaatgtggaatactgttaactattttcagctctggaatattatgggtttttttttgttttttggctttgtatttgaagaaaaaatctctttaaaattttatgagttcaacagtgttagcaaatcaaaagttaagtcataacaaaatttgactttaaccccaaataatttaattaaaaaattaattaaaaaactttttaaatttaaaaatgaatactcgtttgtgataaattatctcacatgctactctttgacatttaatcaatatgtgaaagtgtgttactgtctacacattttgcatttacaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtgagataaatcatcttacttggtttttgaacatgtgaaacttactttctccaatgtaattagtattagaaaggctacctattagtaggaaatgtagacctatgtatggctatgtatgttcatttacatatctttgcctgtttggtgtgtgtatccctttaattgatagacgttctatgtatattctagctaccaatttgttgccagtcatattttcaaaaattattccaacttagtcattttctttttaaccttttcacattttgccacgcagaaattttaaatgtaaatgcaaaatttatacatcttttatagattattaattttaaaccttttatgtgatgcctcatctaatgtcatgaacttatttgctatattttcttttaatccttctgtttttatatttagtcttcaattactctgaacttaattttgcatatagtgtgaaatattactgtaagtttttttcactgttaacaaagtttcattatcatttattgaataatctagaatattttaaaatttttaaaattttctttagtcgttaacatattttctttttagactaatatttggattgatttaattatagataagaacaatagaggaatgtattattgatcaattgtgttttccttttctttttttgagacagagcctccctttgttgcccaggttggggtgcagtgatgctcttggctcactgcaacctccacctcccaggttcaagtgattctcctgcctcagccttctgagtagctgggattacacacatgtgccaccatgcctggctaatttttttgtatttttagtatagacagggtttcaccatgttgaccaggctggtcttgacctcaggcaattgggctgcctcagcctcccaaagtgctgggattacaggccaacatgcctggccaattgtgttttttcttttgaaaatttttgccttagaatggttagctttagatgtcatataatagttaaatggtattatatagatattattattaattataaatgattctcataggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatgggtgagttatcacttctgtttcttttttttttttttttttagctattcaccaattagctcttccctttatcagttctataatttaagcactagcttaaaaaataccttgcttcatgttttttattgttgttgttgttgtttggagatggagtttccctcttgttgcccaggctggagtgcagtggcgtgacctcggctcactgcaatctctgcctcccgggttcaagcaattctcctgcctcagcctcccaagtagttgggattacaggtgcccaccaccacacccagctaattttttcgtgtatttttagtagagacagggttttgccatattggccagactggtctcgaactcctgacctcaggtgatctatctgccttggcctcccaaagtgctgggattacaggcatgagccaccgcacccagctgttttgtgtatttttaaaatgggtaatagtgtggccttttcactgagaaaaaacagtgaatttatagtaataagacctttctctcttcttactctcacttcgacaaggcacatatttattttttctttgtataaaatggggttaatatttttatttttatttattaatttttttttgagatggagtcttgctctgttgcccaggctggagtgcagtgacaggatcttggctcactgcaacctctacctcctgggttcaagcagttctcctgcctcagctttgcgagtagctgggattacaggtgtgtgccaccatggccagctaatttttgtatttttagtagagacggggtttcaccatgttggccaggctggtctccaactcctggcctcaagagatccacccacctcagcctcccaaagtgctgggattacaggtgtgagccaccacacctggccaaaatggggttaatattatctcccttaggagattattgtgaggaataaatgagatgatgaacagataaattataaaatgtgaaataaatgagatgctaatattgttattaacctaatcctccctgttaacatattatatgtttcctcagtttttgtgtgtgtgtgtgtgtgtatgtgtgtactctgttctttgtcattcttcacttggaaaatattctttgtaatctttttcacatttaagttttaaatttcaagggagattttaattttatttatttcatggcctaaagagaagctatttttatttatttatttttcttgtctctagtagtgtttgatatctagccagctgtccagatatgcttagtatgcattactacactacaccctgctctatcttaccttgcactgtttttttcctgtgatattacaactttcactaagaagaatcttgatttaaaaatgacaactgctaatttgtccctatgatataagcattgatgagaagaattatattcatcacacactaatggatattcttactttctttgaaccttttttttttttccattcttggcaataagtggatggttataatctggccttataccttagctgttctcacagacatcaagtatttttccttcaggctttcaggctaattgaaaaactatctaacagtccttaaagaggccttcacttccataattctcagtttgtgagcatctccctcttgttctgttgaagcagatactttcctgttgttaagcaaaatagtttattatttttctgaaatttcctggacttgccaataattacctgcttggagaatgtttttgtctggaatgtggctattaatatatttttatatttaactattgaatgtttgttttttaatttttttttctttttttgagactaagtctctctctgttgcccaggctggagttgcagtggtgtgatcttggctcactgcagcttccacctcctgggttcaagtgattctcatgcctcatgcccagctaatattttgtacttttagtagagacggggcttcaccatgttggccaggctggtctctaactcctgggctcaagcagtccatctgcctcgatctcccaaagtgttggaattataggtgtgagccagcacaaccagcctgttagtttttatttctgcatgtcaaaatggtactgtaaaaccaaacactctattatcaccattttcagtgacagtagctttttttttttttttttttctgagacagtctcactctatagcccaagctggagtgcagtggcatgatcttggctcactgcaacctccacctcccaggcttaagcgattcttgtgcctcagcctcctgagtagctggggctacaggcacatgccaccatacccgactaattttttgtattttaatggagacagggtttcaccacactgcccagggtggtcccaaactcctgcgctcaggcgatccacctgccttggcctcccagagtgctgggattacagacgtgagccactgtgcctggccaaaattctagcttttaagaataacatttgtaatgattcaaaagtacaatacctttaacatttctttaacatttttgtagagacccccatctctacaaaaaatacaaaaattagctgggtgtggtggtgtgcacctgtagtcctaggttactcacaaggctgaagtgtggggattgcttgagcctgtgagattgaggctacggtgagacaagatcacacccctgcactccagcctgggcagcagagtgagaccctgtctccaaaaaaaaaaaaaaaaaaaaaaaaaaaatcagaatttgaaatcatctacaaattttgatggaaataaggaccttattttaaatataatctgtttagaatatactaccttaggctaggtgtggtagctcacacctgtaatcctagcactttgggaggccgaggcaggaggatcacttgagctcaggagttcaagatcaacctgtgcaacataatgagacttcatctttacaaaaaatacaaaacttggccaggcgtggtggcacatgcctatggtcccagctactcgggaggctgaggcaggatcacttaagtccaggaggtgaaggctgcagtgagctatgatcttgccactgcactgcagcctcagtgagaatgagatcaaaataattttttttaaaaagtaagtaaataaataaaaataaaatatactgccttatttaaattttgaagaaatttgttgcctgttttctacacacttatgaatcattaaaatttagaagttttaaataattcataaactagactgtcctcatttagaagtttttaatttttgtctttttgtacactcttgaaaaattatcctaaagtacttgtggttttactttgaaggcacttttactttcaatttctttctttttttttttttttttgatacggagtctcgctctgtcacccaggctggagtgcagtggcgtgatctcagctcactgcaagctccgcctcccaggttcacgccattctcctgcctcagccccccgagtagctgggactaaaggcacccgtcaccacgcccggctaatttttttgtatttttagtagagacggggtttcaccgtgttagccgggatggtctcgatctcctaaccttgtgatccgcctgcctcggcctcccaaagtgctgggattacaggcgtgaaccatcatgcccagccattactttcaatttctattgtaataggtgatactgtatttttggcaaccaagaaaaaataggtggataacaatgaattctaaactttaaaaaagattatttccatagttttgaagtttccctacaaaatagctacatttaatcattttttatagtcatcaaaaataatgactaatcttgtatcttttgtatcatcattatatcttttcaaaatttaataatagattgatatttaatcctcaccaacaacgttgtaaggaaggcaagacaggtactaacattttccttttataggtaaagaaatagaggctcagtaaattaaatgactgtccaaagaaaggtaagttataatggcagagttggagcaagactctctgaacaattgttctgttgttagttacattctaaatatgatatcctaatatattcagattaatttgtttagtgaaataaattgaacttaaatacttaaattgacacttttaaattttatcttataagtctttaattactcaactttttttatgatctagtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacaggtctgaagttaatatagtgaatttaataatgaaaattaatgtggccagtcttttatgtttatgttgttcattttattgaatgttttatatgctatgcttagaagcttatagattagtggggagagataaacatcaatttggtataatattttaagtacagtaacacacatgtaccctgaggaaggacacttaactcatccatgtggaatagggtgggagatggaagcggatgagccagaggtcaggaatggcttcttggagatggtgtcttaaaaaatgagcagtatagggaggcaagacattataatcagaggcatctctgtggagtgtttgaaaagagcatggtatatgccaaagagtaaagtgtcggttttggaatggtagaggaaagatcacaaataatagaagactttttaagttgcccaaacttcttggagggtgcgaactagggaagtgttatggtcacaatggaattttagctaaatgcctgtggcagttgtggaggaggagtttggaagggctatgattcaaggaattactcttctccttgtgagagttgtggtcctgaatttgggagtgagttagtgggggcaagtgccggttatgtcaggtatcaagcatgaaaatgctggtgaaataatgatttaggcgatgttatgattgtgtagggaagaaaagaaagtaagagcaggtgaggcgaatacagtggaattaaataagagctcaagattggtgggcttttcaaatcaaaaagcaaagtgtgataaaataactagaaaattagtaacttgcagtcttaagatgaatattagccccttcctatctttgtgttcctccttgtccagctttaagtctatggttcatggttaaaatcgttcccttagagtgatgctcaacttcttgtctttttcccactgtgttgtactccgtttgtcaaactccaaccatgtaagcagctggagaaaaattacacagtgggtgttataactggtttcagtttaagttcatgatctcaaacatctttaaaactgcaggactctaacattaccttcaggctggctgtgtttctctagtaaggctactttcccctttgtcaagatgactgtctcttaccttcactttgtttccctgcttccagctgacaatcttgcttcatgattcattaggaaaaatctgcaaatgaaacagcatctgcaccatattctttttcttcccttctgttattttatttatttatttattttgagatagggtcttgctctatcacctaggctggagtacagtggcacgagctcggctcactgcaacctccacctcccaggctcaagggatcctcacacctcagcctcccgagcagctgggaccacaggcgctgctaccacacctggctaattttttgtattttttgtagagacggggttttccatgttgcctgggctggcctcctgacctcaagtgatctgcctgccttggcctctcaaagtgctgggattacaggcatgagccactgtgcctggcttcttctgttatttttaaggaaggatttcttcctgtcaaaattcaatctttctacttgtgttctcaatttcaagatgtaacttcttcatatattccttctttctctagtgtaattaatttctctttgggaaccagagtatatggagcatatagacatgctctggtaaatcctaccttctcctttagatacatcccatctctctgtttccggaacttcacaaccagtttttgaaggaattgtctagtttctttatactgcagtcacttctttgtttctcattcactctgcccatttcaacaagacttctctttttcttttctgttgacactattcttgctaagaaaattggtggccacatgttaccaaatccagtaaatttttcccagccctcattttcttaacctcagtatcattgaccatgcctttctcattaagacatcatttgcttttctcccatggcttctgggatattttattctccagttttcttccaagttatctcacttctcctgtttcatttgccagctcttccttcttgataaatgtagaaactctaatctctatcgtcagtctgcttttcttctttatccatttcctagatcatcccattctttctcatgttgtgagagactgtctttgtgctaactgattcctaaatttttatctttagcttgaatatctcctttgagcccagattgctgtcttggttttcttgaagtcatctcaataacaatatattaaaatggttatttacatttttaaaaatttaaaaattcaataaaactcttataagctatactcaacagaatatgttatcatttggatctagacagttttaggatcctgaggttctttataaaccttatgatcaataacagctattgatatagatttgtatttaaaaggagtaagaatgttgagggaatagaatgcctggaaataagtttataattttactgtgactttgccatgaaacaaatgcttactattactttgaggaaaaatttctcaaaaaattgctgtttcaatataaacaggtggttttatagttttatttccagttgtgtttttttcttgtttttgattgttttttaatcattgaacaaagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccaggtaagataataattgaaaggcaactgtaatgaaaatagccctgaataggaactctggaaaccttagttttttttgttttgttttgttttgtttttgagacagagtctcgctctgttggccaggctggagtgcagtggcatgatcttggctcactgcaacctctgtctcccgggctcaagcaattctgcctcagcctcccgagtagctgggattacaggcgtgtgccaccacaccacatccagccgaaaccttagttttaatactgtttctgtcagtgtcactgagtgtctggaaaatatttaaccctctctaagcttgagtttcctaacagataaaattagagactttactagatgattttaaaaattccttccaggccggatgcggcggctcatgcctgtaatcccagcactttgggagaccaagacgggtggattccccgaggtcaggagttcgagactagcctggccaacatagtgaaaccctgtctctaccaaaaatacaaaaaattagctgggtgtggtggcgagcgcctgtaatcccagctacttgggaggctgaggcaagagaattgcttgaacccgggaggtggaggttgcagtgagccaagatcataccattgcactccagcctgggcaacatgagtgaaactctatctcaaaaaaaaaaaaggtcccttccaatactatatttatatgactttagaaatcccctaaatgaataagatttattatggagtatatctgtattaaaatgttcatttaataactctaaaatgtatataattttagtttgctattaaaagtgtaagccatggatcagtttgtagaactagggattctccatagcctgagaaacattttcatattttatacacctactcacccacctgcacgtctctaaaatggtcctgtagaatcacagagttacagttagtaatgggaataagctgtgtgtctattggaatgggaaaggggtttagaatcattaatttacaatcttgcctttagattctttctaattttgggatattgctttttgtcatatttgacatgtttctcagaagcacaatatataaattctttatttttcacaatcttcttttcattttaaaggatagtacataatcctctttaactttttagtgctaaagcccgaaatccatatttaaaacatcaggacctttgagcttgaatgtttatgtgagaaatatgacaatctttaaacagaatatcaaagatattagatactttttatattggatgtgaaccaaaaagtagtccaaattgaaaaatataataacttcaatctgagattttctatgttgtctacatttatttatgttactttaaatgtgttaggacattgatgggggtcctgccatgtaagtaagcaaatcaattgttaaattaagaaaggtgtgactgggcatggtggctcatgcctgtaatcccagcactttgggaggctgaggcaggaggatcacttgagcccaggagtttgagaccagcctgggcaacatggcaagaccctgtctctacaaaaaattaaaataataataataataaaaaaataagggcaataaggtaaatagtaatttttaaagaatatcagttaaactgtttttggtccccaagctattattgaagtgataattgctattttaaatatttttaaatttctagatcattcattatcatggtgtagtaaagtccatgttaggtcttggtcagctgtctactgttatcactcaggtgaatggagtgcatgctaacaggtaatattttataaaatgattttcttttgttattgcatctgaatggagaatttttagttagtgaattgggtaatttaatgtttagtagagtaataaatgttttatgtgttttcatggtattggagataagcaccaacatttttttttcctcaagtttttcatagtcagtctaccacttaacagcttctgtctaaagagccatccttgaattagatttgctttaacacaaggaacttctagaacccactggctattggtgaggctcagatgggacttcctgggcctcaaagggcatctatgctctgcttacagtatcagtaccacttattttccgtgctagaggttgtgactgatttacggaataccactgtagactgtgtgcattgattttaccctaaatgattgatgaatgtgaaagcagccttcctttcctaaagaaggtgggtttattgtagaaaatcaaattaaacaaaaaataatacatgtatgtggcaaaacattaaggctgagtagttcttccagtttggagattaaatgtggagattagcactgctcttgaagctgctttgctgtgagagctgacagctgtattccttgatttattcaccagactctaaatggctattctgggcagtaaaatctggtcaaaagggaatgggatctcagttaaacaaagattatacaggccactgtttttggactactctgaagccaagtttttctttctcttttttttcaacttttattttagattctgagggtacatgtgcaagttagtgacaagggcatattacgtgatactgaggtttaggatacaattgaacccatcacccaggtagtgagcatagtacccaaaagatagtttttcaactcttgcctccctccctcccccaccccttgtagtctgcagtgtctattgttcccatttttgtgtccatgtgtacccaatgtttagctcccattttattcttttttatagctgcatagtattccattgtgtatatgtgccacattttctttatcccatctaccattgatgggcacttaggttgatttcatgtctttgctattatgaatagtgctgcaatgaacatacgagtgtatgtatctttttggtagaatggattattttcctttgggaatatacccagtaatgggattgctgtgtgttctattttcagttctttgggaaatctctaaaccgccttccacagtggctgaactaatttatattcccaccaacagtgtataagtattctcttttctctgcagccccttctacatcttttttgactttttaataatagccattctgggctgggtgtggtggctcatgcctgtaattgcagcactctgggaggccaaggcgggtgtatcatttgaggccagtagttcaagaccagcctggccaacatggtaaaaccccatctctactaaaataatacaaaaattagctgggcgtgatggtgcacatctgtaatcccagctactcgggagactgaggcaggagaattgcttgaacctgggagatggaggttgcagtgagctgagattgcaccactgcactccagcctgggcagcagagggagactttgtctcaaaataataataataatagtagccattctgattagtgtgaggtggtatctcattgtggctttgattttcatttctcaaataattgtgacgacgagcatgttttcatatgcttgttggctgcttgtatgtcttcttttgagaagtgtctgctcatgtcctttgcctactttttaatggggttgtttgtttttttgcttgttgatttatttgagctttttatagattctgaagccagccttttctaagtactgtttgtataggttccaaaactgtgattcataaagactatcattttacaatgtctaagggcagagaagttcactgttggtcagatggtatcacagtagtggaatttatgaaatcacaagggaagttttacagaagtaaagaaggaatgcttatatgttgtggatatgtttctccagattagttgagagactttatgaataaatagattacagggatttgggagagtcatggctcaaattggggtgtcaaatttctttttgacatagactacacattcagactcctcttttcttctctttgggtctgggatacatagagcctcctgatttgggttgtgaaaaaggcatgcgtcaatattcaatgaaggggtgctgtgtcatggtgaagcaaatgattatggatggggcatgtttttcttggggtaatttctgtttgcattaaacaaatatttttcctaaaatattgactgtgcctgccctatttatcattctttttaatgtacccatttatgtggatacattctcacagcctgatcctgattgccatttgtactttttgctataagtcttcgtgtgacacatcccctttgttatctgatatcccatagataatctgttatcccacagttggataacaaatactgcctaattctactgagatttttatcctgaaatttttatattttggtgtctgatggtaagcttgtaaagtccttcaaaattggacttttgaaaattacatttcagttgtatttctttagccttattctaaactgtttttggtggtggtcataaatttagaaattggaatcctctagcttctatttttagaatttttaaaaatgaaacttgttagatcacttgttgtcttttctttatgtgtttttactacaataaaaagagcaaggaaaacttttgaggatattgattccagcctctctgttactttatttataatatggatatatatgtgctgtatgcagtgttattagattattaaatggaaaattgtacctagcctaggatctaaacatatggcagaaattcagaaagtatgattaataaaaaagaaacatgaggaaagcctagcggtttctgtgtagtcatgatctcaaatatcactggtcatcctaatgtcacctaagtagaatgcttagaacaaaataattagcctatatcatactggttttgcaaactcaaattttaaactaactgaaagtagtttaaaaataggtatatattttacgtagctagttttatatactttgttatgccattgacaaatcattgtaactttcttttgctcttggtattgttctagatacctcccaactgtccgtaagttataccactggcccccctgtatttttgtcttaaatttaattcagaattctgagttattggaattgcttacctctgaatttatgtgtgttcagttggctctttttcttccttgctctttgttcaaattaagcatgcagctatttttacaatgggcttagttattattcaggaattaactctgctctaatatatggcacactttaatttgttgaagaatgtcattttaaatggtgtatcagaagtaattagtgaaaaaatatttttgaaggatggaaagattaaaattttctggatagtttctggatagagataattattttatatctaagaacaaaatacaatataatgcaaattcaataaatataataaatagagtatgtaaaccaatgaaaaatctctgaatgtcaccttaaataaattaaagtttagttgatatgggtttcttttaataggtccgagtggacagatgaattaaacacgtacagagtggaagcagcttggaaattgtcacagtgggatttggtggaaaactatttggcagcaggtaaaattacttcttaaaatataagcagttttaggatgggtgcggtggctcacgcctgtaatcccagcactttgggcggctgaggcgggcggatcatgaggtcaggagatcgagaccatcctggctaacacagtgaaaccccgtctctactaaaaatacaaaaaattagctgggcgtggtggcacgcgcctgtagtcccaactactcgggaggctgaggcaggagaattgcttgaacctgggagttggaggttgcagtgagctgagatcgcgccactgcactccagcctgggtgacagagtgagactccatctcaaagaaaaaaaaaaaaagcggttttaatatgacataaatattcagacttaagtaacttagcaacattcatacttaatatcttagcctgttttatgattgccttgtttagttgttcaaagtagaatgaaaccaggctgggcatggtggctcacacctgtaatctcagtgttttgggaggccaaggtgggaggattgcttgaagccaagagctctagaccagtctgggcaaaatactgagactgtctctgcaaaaatgttttttaaaaaacttagctgggcatggtggctcatgcctgttcacctactcaggagactgaggtgggaggatcactggagcccagaagttcaaggctgcagtgagctataatcatgccatagccctctatcctggaccacagagtgagactctgtctcaaaaaaaaaaaaaggaatgaagccacctgtttgatatttcagctgaccattttatctaatgaaataaagctgactcttggacccagctaccgtgacatttcttgactcttcatttgtttttcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgaggtattttggaatttccatttttatatttctggcctataaatgtcacctgacaggattggaaaatttttttgagtaaataattgatagtgagtttggtttcatgcatagctacactagacagctctttcattctttttacctcacaatcaccctacagttaaaattctaacatacatccttttaaggaaaggcaactatgagactaatgaaaaacataataaaaatatcttatgtttgtcctcttgtaatgtcatagtttgctttctatataaccaaatataatatagacatctatagcacctggcacattggtgcttggtatttgttgtttccctttccttttcatttagaaatgtgtttgatatttccccccaaaaatataggcatcacattactagaaagaatattaacttttataggtgaagaagaaaatgttggaaaacattttaggtctatgaattctacctgaggaaaaatgataaactaaatattgtaattaaggtataagaaatttactacatagcactgtttttttaagttagaagaattcattatatttagtatcaacccgtttggtgatatcttaatgaaactagagattggaccactgagtttaattctgttctgtagctactcagctatatccttgtaccttgaacactgaatcatagacactgactatcatacaagggggaaaaagctagtgtgaatgtatcaaagtttccatcactcttagaaaaaaactacattaatttcataattttttactatcatctgctatgccaggccctcttatagtagcaccagcaatatatgcaaatacctcatgttggtttataatggatccatattttcttttatcttcatttaggtggtaaattttggtttcatacatttgaatttagttttatccatcattctccagtttaattaggaatttgggattcactgcaaatccctaaatatttattttaaaagtttaatgtaattaattttatttatttatttatttatttatttattattttaagggacggggtcttgctatgtcacctgagctggagtgcagtggctattcacaggcataatcatagctcactgcaaccttgaactcctgagttcaagtgatccacctgcctcagtctcctgagtagctggagtacaggtgcacgctaccatgcctggctaaagcaccaaatgtataaaccagcataaattggtgtttacattcagtttgaaaagatataaatgtaattatttacttagcaaggatatattaaagttctaccaaagacaactgtgtattttaaattctttatttctgatttaaagtacttgctttatatatgagattaataaggctgaatatgataacattttaacataggctctatctatcttcagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaaggtttctcacactactttttttaaaaatgtcacttatcttgaatttggtatttggatattatttgggggtgtttgtatttcttaattttctgtctgaatctacatttttctatttttaatgatcagggctacactatctggttgaaaggaacctagaacttaagaatcacttttagacaccatttctttctcttttttaagatgttaaaaacatatctgggggatatgttttttactgataaaaatcaagaataaggttcataataggtaaaacagaacactgtaagaaaagttaagtcaaggctttttaaacaaattaataattaattcctttgaaatagtatatgaagaaggttctgtattgggaacagaggctttcaaaacattggaactacttgcaaagtttatgacctagatttaaattgttttaagttaagttgttgtgtacacttaccaatggtctctctcaccaatgtgttgttacttcctttagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaaggtaatggccagggaaatgtcatcatatatatatatatatatatatatatatatatatatatatatatatatatatatatatagtcgggaattatgtacttccttaaaaggccaactgagagaacataactaatccaaattaagaaccttccttttctatcacttttcttcattagttatctaccatagcctggaagtaattgttctttttactctacagtccccagataccttcccatttcaaggctgaatgtggagttttttcagttttcatctatcttacattttccttgaggaaaacgacctcttaatttttcaccttatgtatgtatacagggtgtatatagtagtgacccagtaaatgttggttaaatgaatgtaactctgtcacttagttgctggcagataattagctctctgtagacttgccagtgttactgtaaatattcagctctgatctagccagaaagggcctagcatctgaacagaagttcacggcagacctcagattaaagccaaagtaataagaagggggttttttaaacattggaactacttgcaaggtttatgacccagatttattttttatttttatttatttatttatttatttattttgaaccggagtctcactctgttgcccaggctggagtgcagtggcacgatctccgctcactacaacctctgcctcccgagttcaagtgattctcctgcctcagcctcctgagtagctgggactacgggtgtgtgccaccacacctggctaattttttgtatttttagtagagatggggtttcaccgtgttagccagggtggtctcgatctcctgacctcatgatccacctgcctcagccacccaaagtgctgggattacaggcgtgagccaccgcgcctggccaataacccagatttaatggctattacttaaatttctcctcaggctagtcaccagtttagaattagtaataggcattactaataataatagcatgttctggaattgatacttagcaactattgttggtgccatttgtggttacaccaacttgtggtggctgagaaaggacaggagaggtttcctggatgagaggggaaagcaatttattcagtgtgcattagtcagtacctggtcattttattgagctagtggtagtctatgtattataataccttaaactcaaaatgttcaaaatgcaatttattacctaatactcaatatctgtttctcctctcatgtttcctacttctctgaacaagactttattccatccttccatcaaaaacagaaatctggacatcatcttaaattccttctgcaacctcacttttcacatccagctggagactaaatctttgttcttcaaccttagaaatatctcttgaatcctctccctcttatttatttccactgctttaacttatgactttattatttacttcctctaacaatattaacaaccattttaggatctcaccatttccctgtatacgttattgcagtttgtgatctttctaaaatccacatcgaatcatgttgctccttcaaaaagattaaatcttacaaagtattcttcatacctttaggattaagcctaactctaggaactacacaaatccctttctgatcaagtcctggcctacttcctcagtgtcattcatcaccatctcaaaaaccctttaaacttcagctaaaatcagactatgtgcttttcttccaattaaaattattattccatctacctagaatgcctttcactaaattctctgccaagaagatttctactcattcttgaaaacctaattcaaattttcttcgttgataacttttcctgactgtagttctcctccattttcctatattcttcaggtaggtttaagggactctcttctctatcctgtataatgctgatgtatattcctctgttgtaacacttagcaaatatgcttttatttcacatagtttcttttctcatgtgactatgaactttttttatgtcagggattttaatttgtttgtgattgtcttcaattccctgaactttgattatagtcctttcttgatatccatggagggattggtcccaggattctctatggataacaaaatctgtggatactcaagtcctttatataaagtggcatacacagtatttgcatataacctgcggacatcctcttgtatacttctctaggctacttataatacctaatacagtgcaaatgctttgtaaacagttgttatacttgtattgcttattcatattatttttaattttttctttgtaatatttctttttttttttaatttaaatttttatgttttgagagagacagagtcttgctctgttgcccaggctggagtgcagtggcatgatcatagctcactgatgccttggactcctgctctcaagcaatcctcccacctcaccctgaactttgtatcaaaggctataagcataagccatcatgcctagctttctttttttttttttaagagagaggatcttgctctgtcacccaggctggagagcagtggtgtgtcatagctcactgtaactgcgaattcctgggctcaagcgatccttccccctcagcctcccgagtagctggaattataggcatgagccactacacctgggtaatttttaaattttttgtagagacaggatcttgctatgttgcccaggctagtatcaaactcctggccccaagcagtccccctgccttggcatccaaaagcactggaattgcagagatgagccactgtgcccagccattcctaatattttctatccactgttggttgaatccattgatgtggaacctgtggctacagagagccaactgcagttataaaattaattagtaaatgaatgaatgagatgaagcaatgtttcagttttagaattttactttaataagaggcaagtaaaagataaacatgaaattacaaatggatttgtacaaaaacataatgaactaatacttttgcagaaaatagaagtatgtttttaaattaaaaggcttattgttgccttttttcttttagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggcaagtatatgtataatgcagtttcagttaactctgttgactacgtaaaatgacttaagtctatatggcaaagcacatgtataaaaataaccaggaaatttttttgacttttcagtgagtatataagtatatggattatcacaaaataaatatactcatgaaactgccaccacatcaagaaatagaatattatttgagctctataaccccactacccttcatcccagtaatcactattctcaccctctgtctcaaagttaactacatcctagcctgaaaatttttcagcaaaaccaatttataacttctttactaggtattaaactttatatagatggtgttgtaagagatatacctctcaataatccatgggtcaatgaaaactttcaatggaaattgaaaagtactttgaactgaatgataataaaaatggcatatcatatcctgtgcagctaaagccattcttaaaagggatttaaatttttatttgcatatattcgaagaaaataaaggttcaaaattaacgagttaagtatctatcccaaagagttagaaaaggaactaaaaaagtagggagagaaataaaaaagtagaagaaaggaaataataaagcaaagagcaggtggctagaatttgtgggacagattaactgagagaaaaaagttaaacagagtagttcctatctgcataggaattgtgttcgctgaataccagcctgcacatgaataattcagaattctatgaggccaagctaggaataactgctggggaaagaataaacatgcagaggctataagaacaatttccagagctcacacgggattgagattcattcagattacaggattgagagttattcagtccaccagccagattaagaggcctcattgcataatatggagcattcagtaaagaccttaaaagggccacaccttagaagtaggactaaattagtcctaggctaaaaactactctatatccatactagaagggcagtaaaacaagctttaagatgattacactgatcttcaagtaaccttactgcctgccagatcaaagcctaacactctttaaagcaagacaacaaaatctaaaacttgacaatgtaaaaatatatccagcatccattaaaaaattactctgtgaatgaagaagcaggaatatttgagccacagataggaaaaaaaataaatcagtagaaatagttctagaaatgacaggatttaaaaacagctattgtatataggctccataagtttaagaacataaacaaaaataagagcatgatgagaagagagagaaatcaaagatacaagaaagacctaaatgggaccaacagccaaagcaaatggcacagacagtgctaatctttagatccaggaagtgttgcattctgatgaagataaataggagtccagctcctgttccttggttacaagaagatgtcatgccacctaagaaactaaccttgatttgcattaaaaactatattatcctaaagggcagtgataatgaggcaagttctgaaaccatacttgtaagtttcaccttcccagttagagagatcttctgaatttattctagtatgtaagacacaacaacttatgaggcacacaaaaactcaccagtacttaacagcagaatttgatagcaaatattccagttctcccatctctgcctgggtactaaagccagggttagggaagagagatgttgtcagactaccaacttttcaggttctgtttcttctgcatacacccctaatttcctgtcataaaggcctcagtagctgcttctcttgttctggttgcctatacatgatgtagacagaaatgagtagagaaaagaatagaggctgactactgtagaatgacatgcagatccaaggggccacatattgcatgattccacttacatgaaatggccagaataagcaaatccatagagacagaaggtagattaatgggtactagagactgaggttggggctgggaagtgactgctaattggtacaattttttttttggagtgatgaaaatgttctggaattaaatagtggtgatggttacacaactctgtaaatatactaacaacaactttaaaagtgtgaactttataatatattaattatatcccaatagagctgtcattttaaaatattacccaaatggcaatctttaaataaaaaaagaagtaaaagatacaaggactaggaaaaaaatataggaaagttattaattgcagatgatatgaatacatatgtagaaaattcaaaagattataaactattcaaaatattgagtgaattaaacaagattgcctgatgattttatttctatatgacaacaagaaaggaatttaaaacataccatttacaagcagaaagtacttgaacagttggatatctgtatgaggaaaaaaatgatcttcaacctctgcctcatatgatagacaaaattgcttcaaaaaagtagattatagatctaaactgaaaagctaaaattatgaatttttagatgaaaaaatagaagaaaatctttacaaccttagggtaggcaaaggttttcttaggtcacacaaagcattaagcatttaaaaaatcctgataaattagatgttcatcaaagttaaaaccttttctaagaaagacagttaagaaaatgaaaaggtaagccatagacttggagaaaatacttgtaatacatatatgacagaggatttgtagctaaattatagagaaccctacaacttagtaagacaatttaaagatctgtgaggctaggcacagtggctcaggcctgtaatcccggtgctttgggaggccgaggcctgaggatcacttgaagctaggagttcaaaaccagcctgggcaatatagtgagaacctgtctctgcaaaaataaaaattagccaggtatggtgacgaatgcctatagttttagctattcgggaggctaaagcaggaggatcacttgagcctaggagttcaaggttacagttagctatgattgcaccactgcattccagcctgagttacagagtgaaactttgtctattaaaagaaaaaaaatacagatctgcaaaagtcttggatagacacttcataaagaatacacgcaaatggccaaaaagcaaatgaaaagatgcttaacatcattagtcattaggaagatgcaaattaaaaccacaatgaaataacacattacacactaaaatggctaaagtctgaaagactagcaatacctattaatgcaataaatgcacctggtggggactataaaaagttaaatctaccatattccattccattcttaggtgtttatccaacagaaacaattacatatgtcaataaaaagacttgtacacaaatgtttatagtaggtttagtcacaaaaactggaaataggccagctggccatccagagaagaatgggtaaacaaactggtacagttgtataatggaatactaccctacagtaagaagaaatgaactactgatacacgcaacaaggtagattaatgtcatagatatgctgaatgaaagaagagggacataaaagactatatgcttatatgatttcatttatgtgacattttagaacaggtataattaatgtatatgcatagaaattatatcagtatttgcctgggtagttggcaggagagtgacggcaagggtgggcgcccataagaactttcgagagttaggaatgttcatcttcttgactggaatgatggttccatgggtgtatatgtcttaagaaagttgatttaaaattttactttattttatttttgagacagggtcttggtctgtcaacccaggctggagtatagtggcatgattacagctcactgcagcctcaacctcctgggctcaagtgatcctcccacctcagcctctcaagtagctgggactacaggcacatgccaccacacccagctaattttttattttgtggagatagggtcttgctgttctgccaaggctggtctcaaactccctggcctctactgatcctcccacctctgcctcccaaagtgctgggattatagttgtgagccaccatgtatgcccagcctaaaatttttaaagatatcatttaggatagcaataaaaatgatgaaatgcctaggattaaattgcacacaagacctctccacaaaataaaaattaaaacattaaaattgagtgaagtaaaaaagaactaaataaattggtagctagaatacatgtatgaatgggaagactcaataatataattatttctctacaaactgacctagaggtttaatgcattactcatcaaatgctaacaggtaattgacaattagaatttaaaacttatgtggaaacataaaggccaagaataaccaagaagcttctctgtcacctttcattttttcagttttaatttgaaataatctttgacttctaaaaagttagtagtagtatagggaatttccatatctaccctttaccgtgtttccactaattttaatatcttacactaccagagtatcagaagtgggaaattaatattgataaacaatactgttaactatctgtagaccacatttcaccagttttcccaatagtgttcttcttctgtctagaattaaggattccatatagcattagttgtcatatctccttagtgacctccaatctatctgagatgctctttactgtatcgtgtgaggtcaggtgcagggagaaaatagttggcccaatcaaaagaggtaattggggagagtttaatgaaaaactagattaagggaaattaacaaaggatggtgaaagtaccccatggctagcaacaacagagagtcgttgctaactctagacctgaaggagcaaaaggatagggcatttactggaacctgtacagggagctaaatttgtaggaaaggaccattggaccagaacttaaccttagggaaagaaacaccaccactgtcaactgcagcccagcaggaaggaaacgagcaggtataaagaccttaacctcactctccccctcaccctctaatctattgctaccttccattgattgaacttcacaggaagccagagggcaaacaggcccattgatataaatcatcaatttcagtttgctggggcactgagcagagtggaaaaggctaaagttggcaagtgtatctatctggaggggcaaactgtgaataaccaaaatagtcttttcaataaatgttgttgtatcacttgggtatcttataggaaaacaaaaaatcaaacttgatcccttcttcccaccataaacaaaagtaaacttgaggtagattgttaatctaggtcaggacttcttaaacataacaaaaacactaaccctaaaataaacaataacttctgtttatcagaagataccattgtgagttagaggcaacctacagattagaagatatttgcaatacattagaggctcatatctggaatatgacccagcatgtccccagaggataaacacaagaatgtttataacattattatttgtagattttatattggaagtaatccaaatggcaatcagttatagaatggataaatatgttgtagcatattcttataatggaatactatatagtaaaccaaatttatatgcaataacttggattgatatcacaaatgtaatgttgaatgaaataagccagataaaaaatataatacacgtagggctgggcatggtggctcatgcctataatcccagcactttgggaggctgaggcaggcggattgcttgagctgaggagttcaaggccagcctaggaaacatagcaaatctccgtctctacaaaaaatacaaaaattagctgggtgtggtggtacatgcctctagtcccagctgctccgtaggctgaggagggaggattgccttgagcctaggagttgtggctgcagggagtcatgagcatgccactgcacaccagccaggacaacagggcaaaaccttgtctctaataataatatgtatttttttggagatggtgtctcgctctgtcgctcaggctggagtgcagttgcgcgatcttggctcattgcaagctccgcctcccaggttcaggccagtctcctgcctccgcctcccgagtagctgggactacaggcgcctgccaccgcccggctaattgttttttttttttttttttttttgtatttttagtagagaccaggtttcaccgtgttagccaggatggtctcaatctcctgacctcgtgatccgcccacctgggcctcccaaagtgctgggattacaagcataagccatcttgcccagccaataataataattattatagtatgattctatttatataaaagttcaaaaacagacaaaaaactcctggagttcttgtatgaggatgataaatttgtaataattgatcaagttgtatacataagattcatatatgtttctgtatataaactttatttttcaaaataaaacttaaaaatcttaactaaaaagggagcgagagagaagagagggaggaaggagattttatataaaggtaattactttgtgataattgatcaagctgtaaatgtaatattagtgtatttttcagtatgtgaattttacttttcaaaataaatatttaaaatctaagctgaaatgagagagggaggaggaaggaagttagggaaggaggaagaaaggaaggcaggaagacaggcaggaaagaagaaaggaaggaaagactagattgactaatatgtttttctggcagcccttaccctgtgtggctgattaggtacatgaacctagcatgtgccacacgtctaatcatatcattctgtcctctattcccaggcaggtttgtgtctgtagagtctcaagattagagtcagtagaaactcaagatctcacttaaggtttctggtctaaactgttctcaaacttctttagatgaaaagtggaacttcaattaaaaaaaaaattgtcagtgatcctgtgtatttcccatcacatttcatgtaatattaaaaattaataaaccacacaaatatttaaggcaggaacagcaaaaagaaatgacaaaggagactaagtgagagtggccagaaagagaggagaaaacttggaagatggtggcctcacagaagtcaagggatgaaagcatttgaaataagtgacttggacaacagaaacatattgaagagagttcaaatgagatcagagttgtaaaatatctcttggatttaaggagctccttagtggagtggtgaagactgaagctgaaaagacatagttttaggaatcaatgtgaggtagagaatcctttttagaagcctgcttctgaaggaattgagagaaagggcaataacttgtgagagatcttggagaaaaacaaaatatgtgatttttattttaccaaaatttttatgctttttaaagtcctacactctttagagacttgatattacttctgctttgaagatttttaaaaatgcctttcatgatatatgtgtatatacacacacacacatatcatatatatgtataaaaaaatttaacccatccagacactactttgatgtatcttttaaagtggtgacataaatggagttttctcctaagttgcgaattcttccagcactatttcatgttgggcagtgggcaacccaccagaacaaatcagccctcctgagaaaacctttacaagaagttagctattccttttccacatcaaagattgagtctgcttttgactttgctctgcctagataaaggtcacatacttttgatccctaatcatctattcatattttacttcccagcatagcgtgggatttccttaggtaggtatcctatgttcttttttataggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcaggtgagtatgagaactgcatgtttgcagattaaatatgtaaggatgactattaatattgaaactgttatcacatgtcttagcatattctaggtattttctggcttatgactgattcagtgtatcaccttagataagatgtaaatttttcctttatgcaacttttttcttcactttaaaaactttttaaatgaaaaaagtgatatagacatgtgttttggaaactctctctaactatgttattcctctgctctcacaccaacacagcaatcatcaacacagtagaagacttacatgaccaaagatgtgggtttttttccccatacaccaagcagtggacaccagcttggtgtcctccaattctgttctgacactctctacctggagacggtgtcatacctcagaggttgagggcttggtgacacaagaccatctcctccttcccttagttgcaagtctgggcctctggaacttctgaccaactggcttcaagttggggttctcacaacctcctcttgggttcaataaatttgctagagtggctcacagaactcagggaaacatttttactagtttattaagaaagatattttaaaggatgcaaataaacagtctgatgaagagataggtagggtgaggtctggaggggtccggcacaggagcttctgtctccatggagatgggctgtgccatcctcctggcacgtggatgaggtcttcttcaccctcctgtcagcctccacgtgttcacctctctggaagctctccaaactctgtcctgtggggtttttaatggagtctttattacatgggcatgattgacaaccatgtagaaatgtgagtggacaaatagctcataatgtaaacccagcaaggtctgtctgttcagacttttcttggccttttctatgtagcattccttcctctaggatatggggcaggatcctctctgggatgaggatcttttgactcacagtcagattagaatcctcccttaggcagatgagtgaaggacaggagaagctcatagagagagattctgtttcctgaggcctaaagtgccctgacattaaaacgaggagttaggagccagtaactgtgaactaaaaccaatatatgtattataattccacagcctggatttttaaaaaaattcaacagcaccaaattaagtatccttctcattccagaccctcatcccctgagtccccaaccatagaattccagaagacccttaatgtcatatttcgtggttatatatatatatattttattttattttatttcattttattttattttatttattttaagacagagtcttgctctgtcgcccaggctggagtgcaatggcacgatctcagctcactgcaacctctgcttccaggttcaagcgactctggctcacccttctgagtagctggtattacaggcgtgtgccaccacacccagttaatttttgtatttttagtatagacggggtttcaccatgttggtcaggctggtctcgaactcctgacctcgtgatccacccaccacggcctcccaaagtgctgggattatagatgtgagccactccactcagcctttgtggttatattttattgcaatggagtacttccttctagcccattccaataagaagtggtataatatatatacatgaaaatgattttgacattagacttgtagaaagtacttattcttaaactagttaataggtgaaatataacttttaatttcatatatcggtgtattatagtcaagtataatctcaggcctactgtttatgtttttataaattattaattgctaagaaacaatatcattccatacattctccttatcatactcatgtaccattgctttacatggaaggatatcttcagatcaatatatctgttaaaattgcctattatgaggtactatgacttctcagttaaatattttcagaaattaaagcaatatctgtaagccacgggtggtggtgtgtgcctgtagtcctagctactttggaggttgaggtgggaggattacctgaacctgggacgtcaaggcagtggtgagctgtgattgcaccactgcacagcagcctggataacagagcaagaccctgtctcaaaaaaaaaaaaagaaagaaagaaaaaaaaaaaagaaagaaagggggcatatgttctcaggatctcctgagggctgtgtcacacgagaaaaaaaatggaaaaaaaaagcaatatttgttcatcatcaatggtattagggtagcaaaatgagtaaaggtactaaaggcagttcttctttttttttttttttaattgacaaagtatcactctgtcactgaggcaggagtgcagtacaatcatagctaactatgaccttgaactctgggctcaagtgatcctcctgcctcagcctccttagtagttaggactataggcacatgccaccatgcccaactatgtttttaaataattttttgtagagacagggtctcactatgttgctcaggctgatcttgagctcctggcctcaagcaatcttcccacctcagcctcccaacgctctgagattacaggtgtgagccatcactcttggcccagttcttttgaaaaatgagtaatagcttcttttgtttgctctttagtcttagtatatatcatgtgccttgggatatagaatttacttaacacatttcttttaaaacaagtggctatataaagtcctctatatgcataaaactgttatgtatagtgagtatttttaaagtacccttcaggaatgtaagtacattttaaaacctgtttctatccatagtagttaaaataaaatatttgtatgcttaagggagtaaacttagctattgagacatatttatcccctgactgaataattgtgttattactgattaaatatcaatgtttgcccttaagaatctaggatccaattagggttagaaaccttaagtacataaaacatttaaataatggtacataatagaatgtgtgattagatatcaaaataggctgggctcagtggctcatgtctgtaacctcagaattttgggaggctgaggcaggcagattgcttgagcccatgagttcaaaaccagccagagcaacatggtaagaacccatctctaccaaaaaaaatacaaaaattatccaggcatggtggtgcacacctgtggtcccagctacaagggaagctaagccaagaggattgcttgagcccaggaggtggagattgcggagagctatgatcatgccactgcactcctgcctgggtgacagagaaagactctatctcaaaaaaaaaataaataaataaatcaaaataaatgtagtaaatatcagatatggctgggcacggtgattaatgcctgtaatcccagaattttgggatgctgaaatggaaggattgcttgagcccaggagttcaagaaaagcctagggaacatggcaagacctcatctctacaaaaaataaataaatcagccaggcatagggtgtacaaccatggtcccagctatgtgggaggctatattagccagataccaaaagtgaaccaaacaagtccagaagtcatggaggtcaaaagtcaagccacaagccactggctttatgatttcaaaagtgtacttctttgcattgaattgctacaaaagtctggtaaacctcatgaagaaggtatactagtaatccaaattcaacagcacattaaaaggatcattcaccatgaccaagtggaatttactccagaatgcaaggatggttcaacatatccaaatacatatatttgatataccacattaatagaatgaaggacaaaaaccatatgatcatctcatctcaatagatgcagagaaagcacttgacaaaattcaacatccttttatgactaaaaagtttcagaggggcggttccaagatggccgaataggaacagctccagtctacagctcccagcatgagcagcgcagaagatgggtgatttctgcatttccaactgaggtaccgggttcatctcactggggcttgtcagacagtgggtgcaggacagtgggtgcagcgcaccgagcatgagccgaagcagggcaaggcattgcctcacctgggaagtgcaaggggtcagggaattccttttcatagccaagcaaagctgtgacagatggcacctggaaaatcaggtcactcccaccctaatactgcgcttttccaatggtcttagcaaacagcacaccaggagattatatcccgtgcatggctctgaaggtcccatgcccacggagcctctctcattgctagcatagcagtctgagatcgaactgcaaggcggcagcaaggctgggggaggagtgcccgccattgctgaggcttgagtaggtaaacaaagtggctggaaagctggaactgggtggagcccactgcagctcaaggaggcctgcctgcctctgtagactccacctctgggggcagggcatagctgaacaaaaggcagcagaaacctctgcagacttaaatgtccctgtctgacagctttgaagagagtagtgcttctcccagcacggagtttgagatctgagcactgacagactgcctcctcaagtgggaccctgacacctgagtagcctaactgggaggcatcccccagtaggggcagactgacacctcacacggccgggtacccctttgagacgaaacctccagaggaacaatcagacagcaacatttgctgttcagcaatatttgctgttctgcagcctccgctgctgatacccaggcaaacagagtctggagtggatctccagcaaactccaacagacctgtagctgagggtcctgactgttaaaaggaaaactaacaaacagaaagggcatccacaccaaaaccgcatctgtacgtcactatcatcaaagaccaaaggtagataaaaccacaaagatggggaaaaaacagaacagaaaaactgaaaattctaaaaatcagagggcctctcctcctccaaaggaacgcagctcctcaccagcaacggaacaaagctggacagagaatgactttgacgagttgagagaagaaggcttcagatgatcaaacttctccgagctaaaggaggaagttggaacccatggcaaagaagttaaaaaccttgaaaaaagattagacgaatggctgactagaataaccaatgcagagaaatccttaaaggacctgatggagctgaaatccacggcacaggaactacgtgacgaatgcacaagcttcagtagccgattcgatcaactggaagaaagggtatcagtgattgaagatcaaatgaatgaaatgaagcgagaagagaagtttagagaaaaaagaataaaaagaaacgaacaaagcctccaagaaatatgggactatgtgaaaagaccaaatctatgtctgattggtgtacctgaaagtgatggggaaatggaaacaagttggaaaacactctgcaggatataatccaggagaacttccccaacctagcaaggcaggccaacattcaaattcaggaaatacagagaacgccacaaagatactcctcgagaagagcaactccaagacacataattgtcagattcaccaaagttgaaatgaaggaacgaacgttaagggcagccagagagaaaggtcgggttacccacaaagggaaccccatcagactaacagctgatctctcggcagaaattctacaagccagaagagagtgggggccaatattcaaaattcttaaggaaaagaattttcaacccagaatttcatatccagccaaactaagcttcaaaagtgaaggagaaataaaatcctttacagacaagcaaatgctgagagattttgtcaccaccaggcctgtcctaaaagagctcctgaaggaagcactaaacatggaaaggaacaatcggtaccagccactgcagaaacatgccaaattgtaaagaccatcgatgctaggaagaaactgcatcaactaacgagcaaaataaccagctaacatcatactgagaggatcaaattcacacataacaatattaaccttaaatgtaaatgggctaaatgctccagttaaaagacacagactggcaaattggatagagtcaagacccatcagtgtgctgtattcaggagacccatctcacgtgcagagacacacataggctcaaaataaaaggatggaggaagatctaccaagcaaatggaaaacaaaaaaaggcaggggttgaaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccaagagacccacaaagagacttagactcgcacacaataataatgggagactttaacaccccactgtcaacattagacagatcaacgagacagaaggttaacaagaatatccaggaattgaattcagctctgccccaagcagacctaatagacatctacagaactctccaccccaaatcaacagaatatacattcttctcagcaccacaccacacctattccaaaactgaccacatagttggaagtaaagcactcctcagcaaatgtaaaagaacagaaattataacaaactgtctctcagaccacagtgcaatcaaactagaacccaggattaagaaactcaatcaaaactgctcaactgcatgggaactgaacaacctgctcctgaatgactactgggtacataacgaaatgaaggcagaaataaagatattctttgaaaccaacgagaacaaagacgcaacataccagaatctctgggacacatttaaagcagtgtgtagagggaaatttatagcactaaatgcccacaagagaaagcaggaaagatttaaaattgacaccctaacatcacaattaaaagaactagaaaagcaagagcaaacacattcaaaagctggcagaaggcaagaaataacttaggtcagagcagagctgaaggagatggagacacaaaaaacccttcacaaaatcaatgaatccaggagctggtttttggaaaagatcaacaaaattgatagactgctagctagactaataaagaagaaaagagagaagaatcaaatagatgcaataaaaaatgttaaaggggatatcaccgatcccacagaaatacaaactaccatcagagaatactataaacacctctatgcaaataagctagaaaatctagaagaaatggataaattcctggacacatacaccctcccaagactaaaccaggaagaagttgaatctcttaatggaccaataacaggctctgaaattgaggcaataattaatagcttaccaaccaaaaaaagtccaggaccagatggattcacagccgaattctaccagaggtacaaggaggaactggtaccattcattctgaaactatttcaatcaatagagaaagagggagtcctccctaactcattttatgaggccagcatcatcctgataccaaagcctggcagagacacaacaaaaaaagagaattttaaaccaatatccctgatgaacattgatgcaaaaatcctcaataaaatactggcaaaccgaatccagcagcacatcaaaaagcttatccaccatgatgaagtgggcttcatccctgggatgtaaggctggttcaacatacacaaatcaacaaatgtaatccatcctataaacagaagcaaagacaaaaaccacatgattatgtcaatagatgcagaaaaggcctttgacaaaattcaacagcccttcatgctaaaaactctcaataaattaggtattgatgggacatatctaaaaataataagagctatttatgacagactcacagccaatatactgaatgggcaaaaactggaagcattccttttgaaaactggcataagacagggatgccctctctcaccactcctattcaacatagtgttggaagttctggccagggcaatcaggcaggagaaagaaataaagggcattcaactaggaaaagaggaagtcaaattgtccctgtttgcagacgacatgattgtatatctagaaaaccccatcatctcagccccaaatttctttaagctgataagcaacttcaccaaagtctcaggatacaaaatcaatgtgcaaaaatcacaagcatacttatacaccaataacagacaaacagagacccaaatcatgagtgaactcctattcacaattgcttcaaagagaataaaatacccaggaatccaacttacaagggatgtgaaggacctcttcaaggagaactacaaaccattgctcaaggaaataaaagaggacacaaacaaatggaagaacattccatgctcatggataggaagaatcaatatcgtgaaaatggccatactgcccaaggtaatttatagattcaatgccatccccatcaagctaccaatgactttcttcacagaattggaaaaaactactttaaagttcatatgaaaccaaaaaagagcctgcattgccaagtcaatcctaagccaaaagaacaaagctggaggcatcacgctacctgacttcaagctatactacaaggctacagtaaccaaaacagcatggtactggtaccaaaacagagatatagaccaatggaacagaacagagccctcagaaataatgccacacatctacaactatctgatcttcgaccaccctgacaaaaacaagaaatggggaaaggattccctatttaacaaatgatgctgggaaaactggctagctgtatgtagaaagctgaaactggatccttccttacaccttatacgaaaattaattcaagatggattaaagacttaaatgtcagacctaaaaccgtaaaaaccctagaagaaaacctaggcaataccatttgggacataggcatgggcaaggacttcatgtctaaaacaccaaaagcaatggcaacaaaagccaaaattgacaaatggggtctaattaaactaaagagcttctgcacagcaaaagaaactaccatcagagtgaacaggcaacttacagaatgggagaaaatttttgcaatctactcatctgacgaagggctaatatccagaatctacaaagaactcaaacaaatttacaagaaaaaaacaaccccatcaaaaagtgggcgaaggatataacagacacttctcaaaagaagacatttatgcagccaacagacacatgaaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacgtttacactgttgttgggactgtaaactagttcaaccattgtggaagtcattgtggcggttcctcggggatctagaactagaaataccatttgacctagccatcccattactgggtatatacccaaaggaatataaatcatgctgctataaagacacatgcacatgtatgtttattgcggcactattcacaatagcaaagacttggaaccaacccaaatgtccaacaatgatagactggattaagaaaatgtggcacatataccccatggaatactatgcagccataaaaaaggatgagttcatgtcctttgtagggacatggatgaagctggaaaccatcattctcagcaaactatcgaaggacaaaaaaccaaacaccgcatgttctcattcatagctgggaattgaacaatgagaacacttggacacaggaaggggaacatcacacactggggcctgttgtggggtgaggggctgggggagggatagcattaggagatatacctaatgttaaatgacgagttaatgggtgcagcacaccaacatggcacatgtatacatatctaaaaacctgcacgttgtgcacatgtactctataacttaaagtataattaaaaacatatatatataaaacataacatgtatataagttgtaaagcataataatagaatgaacatccattaatctagtctaacctttatgtcacccctctatccctggaggcaaccactattcccaattttgtgtttttcattcctttgttttttaaaataaaagaggctttttaaaaaaaaacaaactttttttaaaaaaaaaatatgtatagaaggaatgtacctcaacacagtaaagaccatgtatgataaccccaaagataacatcatactcagtggtgaaaagttcaaagcttttcctctaagattaagacaaagatgcccactcttgccacttatattcaatatagtaccaggaatcctagccatagcaattcgagaagagagataaataaaaggcatccaaattggaaaagaagtcatcaatttttttctatttgcagacgacatgattttatatactgaaaccctaagactccaataaaagactattagaacaaataaatgaattcaataaagttgcaggatataaaggcaacatacaaaagtaagtagcatttctatacactaataacagagtacttgcagataaattaagaagacaatctcatttacagtagctacaaaaataaaatataatacttgggaataaatacaaggcaaaagacctatacaatgaaaactataaaacattgatgaaaagaaattgaagaagacatgaacaaatggaaagatatcctgtttatgtattggaagaattaatattattaaaatgttcatagtgcccaaagtgatctacagattcaatgtagtttctatcagaattccaatagcttattctttctttccttttttttttgttttgttttgtttaaaaattctggctgggcacagtggctcacacccataatcccagcactttgggaaactgaggcaggtggatcacttgaggtcaggagtttgagaccagcctggccaacatagtgaaacctagtctctactgaaaatacaaaaattagccaggcatggtggcacacatctgtaatcccagctactagggaggctgaggcaggaaaattgcttgaacccaggaggcggaggttacagtgaaccaagatcgtgcctctgcactccagactgggagtctcaaaaaaaaaaaaaaaaaaatccaataacttttttcacagaagtagaaaaaaaaatcctaaaatttgtatggacctagaaaagacctcagataaccaaagaaatcttgagcaagaacaaagctggccgggcgtggtggctcacacctgtaatcatagcgaggctgaggtgggtggattgcctgagctcaggagttcaagatcagccagggcaacacggtgaaaccccatctctactaaaatacagaaaattagctgggcatggtggcatgcacctgtaatcctagctactcaggaggttgaggcaggagagttgctggaacccgggaggtggaggttacagtgagccgagattgtgccattgcactccagcctgggtgacagactgagactatgtctctaaaaaaaaaaaaaaagaataaagctgaaggcatcacactacctgacttcaaaattataccacaaagctataataatcaaaacagtatgacattagtattaaaatggctacatagaccagtggaacagagaccctagaaatgaatccacgcatttacagtcaattgatctttgacaaaggtgccaagaacccacaatgcagaaaggacagtctcttcaataaatggtgttgggacaactggatgtccacatgcaatagaatggaattacactcttaccttacaccatatacaaaaatcaactcaaaatggcttaaaaacttaaatgtaagacctgaagctgtaaaactactagaagaaaacatagaggaaaaggttcatggcattggtttgggcaataatttttttggatatgaaccaaaaagcacagccaacaaaagcaaatatagacaaatgatattatacaaaccaaaagacttctgcatagccaaggaaacaatcaacagagtgaaaagacaacctatagaatgggagaatgtatttgcaaaccacacatctgatagggggttaatagccaaaataggtaaggaactcaaacaacttaatagtaagaaagcaaatcacctggccaggcatggtggctcatgcatgtaatcccagcactttgagaggctcaggcagatggatcgtttgagcccaggagttcaagaccagcctgggcaacatggtgaaacccccatctctacaaaaaaatacaaaaattattcgggcgtggtggtatgcacctgcagtcccagctgctcaggaggctgaggcaggggcatcactttagcctaggaggtggaggttgcagtgagccaggatcatatcactgcactccagcccaggcaacagagccagatcctgtctgaaaaaataaaaataaaaatagaaaaaaggaaacaaattacccaattaaaaaaaatgggaaaagggtctgagcagacatatttcaaaagaagacataaaaatgaccaacagaggtatataaaaaaagttcggcatcgttaatcatcagataaatgcaaattaaaaccacaatgagatgtcacctcacacttgtttgaatggctatcatataaaagacaaaagataacaagcattggagaggatatggggaaaagggaacccttatacactgttggtgggaaggtaaattagtagagccattatggaaaacagtatggagattccttaaaaattaaaaatagaaatatcatatgatctagcaatcccattatggggtatatatctaaaggaaattaaatcaatatgttgaagagatatctgcactcccatgttcattgcagcatcttcacaacagccaagctatggaatcaaactaagtgtccatcaacatgggaatgaataaagaaaatgtggcatatgtatgtatacttatacacacacacacacacacacacacacacacacacacacaatggaatactattcaggcttaaaaaagaaggaatcctgttatttgtgcgaagatggatgaacctggagattattctaagtgaagtaagcctggcacagaaagattaatactgaattatcttacttatatgtagaatctaaaaatgttgaactcatagaactagagagtagaatggtgattaccaggggttggagtagtgaggagttggggagatgttggtcaaaggacataaaacttcagttaaatagaaggaataagttaaagagatctactctacaacatggtcactatagttaacaaatgttttgtattgaaaattgctgagaatagattttattccacaacaaaataaatatgtgaaataattagcatgcgtgagttagcttggtttagctcttccacaatgtatacatgtttcaaaacatgtgcacaataaatatacacaatttttatttgttgatttaaataaataaatgaaatgtttaaaaacaaaaacattatgttgtgcacctttaaaaaaacctgctagctctcctaatttctggttaaattaatcttgacaaaataagaaggggaaaagaaagtccccacttcttctatagttgtagaatggtaaatgcaattctatgtcattaaactgtctctatgggtctcaaaaagatatctgtacattcgtgttcatagcaacattattcataatagctaaaacatgaaagcagtgcaagagttcattgggagattaattgatcagcaaaatgtgatgtagacacaatggaatattattctgctttaaaaaggaaggaaattctgacatatggtacaacatagatgaacctcgaggacattatgctaagtgaaataagccagtcacaaaaaggacaaatactgtatgtttccacttatatgaggtaccttcaatggtcaaattcatgaagacagaaagtacaatggtggttgccagagactgggtggggaaggagacgggaagttactgtttaataggtacgaggttccaatttgggaagatgaaaaaagttctggagggggaatggtggtgatgattacgcaacaatgtgaatgtacaaccatattaatataacactgaactgtacacttaaaaatggttgtgatggcaaattttatgttatgtatgttttaccacaataaaatttcttttgaaaataaactgatgtccaggcccctaaaaaattcaagaaggagagaactttaacttttcacaaattttaccagaaacagcgttgagtggttggtttgtaggatggtgcagaaactagacctgatggaagatgtatactggtgagtggcaagatgctaagattggaaaattatggagataaaagattctgaatgtttgaatcccaggcagaatcatttatatagttttaatatgtaggtattgattcctgttttttaataaggggagagcatgataaagccagaatttcaggaatgttagtctggaatttactgaagggtagaaatatggatttagggtgaccaagttattataatttcccagaaatagaatgattggacctaacctaggcttatggccaaagaatgcaaatgaaggcacagagatcctaaggaaaaattgaaagaagtattgatagactttgattagagcagaatttgtataatgtacaaattctgtatactgtaagtggaaacatacagtatgtacatgtttttggtacagggaatgtagaactaagtgagctaaaaaggagacagaggagtcaaaaataacttctaggaagaaatattgataccataatttttgtgaaaacggtatgtggtagtttgaatctttaaattttaattcgtataatataaaaatgacagctatgctaatagtgtttcttgtctatataattgcagatctctacaatatggaaatcagttcatatatcagtcaatgccacgaatgttaactctatggcttgattatggtacaaaggcatatgaatgggaaaaaggtataactcttcacgtaaaagttttaaaggactaggaattataactttggtataaagtcagatttggctggacagtctaatttcctagaagcttggaatgaatttgataattaagatattatgtaagtgtgagtaagatactaaatgttaaaaaggaaagacaaatcatagacttttaaagtagttttaattcagggccacaaatacaaatctgattatttcttaatgaatctaacacatattaaaatgtgttagttttagccaaataatttaccctaaaaattaaaatggatagtgaaaattaatgtcccttgggtttttgaatggctctaaatattttttctggttggacagagacaactatcttttcacaaattggcaagtgacctaaccttgggcatgggaataacatactttaaagctatttttaaagcaaaatttttcttctgtgaaatgaactgatatactgatttttctctttcctttattgttttttaaacttatttcttcccccagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaaggtaaaagggtcttttacctttttatatgaaaagatcttttaccattttatatgaacttgattatgtaatactaatatgtagatacaagttccagggcgtctctcctgtattagattagtaattttaaatatttttttaaagagagaaatttatagcattatatcttaatatttggatatatttaccatatgaaatgaagtaactagtatgtttaagatcaaataattcagcatgtgttttctttatgaagtctagtaaacagttaatgcttgatgcaaaatggttacctatgttttcacaaatattttaatccaaactacctgaatttttattttttttcccttaagaaacaggatctttctctgttgcccaggctggaatgcagtggtgggatcatagctcagtgcagcctcaaagtcctgggttcaagtgatcctcttgcctcagcttcccagtagctaggatgatagcggtgtgtcaccatgtacagttaatttttaaattctttttgtagagatgggatcttgctgtgttgctcaggctgggctcaaactcttgggctcaagtgatctttctgctttggcctcccaaagtgctggaattacaggcatgagctatcgtgccccgccagtacctgaattattaatactaaaaaaccgttattgcatcattaatgggaattcatatgttggtcaatatatgtaataagtaaatgtttagagaatttagacaatacagagacataaaacaaaaattaaaattcacaccttgggccattcattaatgttttgatgtaattttatttgtatattttctagcatattttaacactaaatttaattatgttgccgtacaatttcatatttttcactttattgtttccatgttattaaatataatttgaagatataattttaatatataaaattctaaaaaatagccttcaataacttatttaactgtttagttaatcattaaggttatttctatttttcttgcaattgtaacacatctagatatgtctatgtttattctcacttgtaattatttctccagggcagatccctataactttataattcacaaagttatagggtggcaatatttgtatggctcttgatagcattgccaaataaattttcagaaaatttgtatcatataaactctcatcatgaatactttttaagttttttgtcaagcaaaaaatttatcttttaaaaatcctgtataaactcttttttatgacatttaactcttttttatgacagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggtactatcataatcttagtgcttataaactgatgttgggtaattatgtatataatttgagcagattttttcatttgattaattaaattaaaattctaactataggtgtacacatatatcaaaatgtatattttaattatgtatgatttgtcttaataaagcagtttttaatatttctaatacatcttacttccaaataccctctaatatttctaaaagttcttcttagtgtgaattaagaattttccgagagtagatatccatgtttctcagcaatttttagtagagaatatgaaataagccataaaaatataagtatgtaaaatattctaagttacttatggtagtctatgattatatcatatctttaaactttcaaaattcatatacattattaaactacacttacgatagggaagagggttggggttttgcttttcattcttttagtacacatttcagtgcctatgaggggacaagcactatgctaagggaaacaagatgaataaaatctattctcatgcctgaggtgcttacagtcttttagggaactaagcagatggttatctagagtaataagtacttttttcggtagatttgtgactaaagtaggaacatggttacaggagtaaccccataattctacctaagtattagagaaaaacccccaaggatgtataggaaagataaaagtgggaggtgggggtggttataaggagggagagagaagttctttaataaggtacatagctagacttcacttgacaaatattcagagtgcatcagtgtttatagatgaaaagatacagactatttctcacctttcctttatcaataaacatctcaaaagggtaatctgcatttattatctccattaatcccatttgacctctgatgcacttgacattatcaaaaacagtgttatggtggccaacatttattaaaacactaacactgttgtaagtgctttacatgtacaggtttccagttctttatctgaaacctttgtggcaagctacacttagaaatttaggatttttaagattttagtgcatatttaatatttgatatttccactgagggtaacctgttggagtatcccataatcaaacacataactgtttcttcagtgagagtttaatttacagagctctttggattttctaatatttgataatagattataggcctctactctctcctttaatcattaaacaatcctatgatgtaggtactattattaatgaggtaaatgacagaggttaaaatgggatgattaggaaatacttagaaaaccacagactgctgaacctttgtaatcaaaatattgtaaaagtgaaatttttgttatagtggaatttaaggtaaaaacaaattaaaatgcactatttattttttcaggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtaaacttcagttttatatgactatgattttaaaatttagttgttaaaaacttcaaattaagataaaaagtgtatttcacaaaatctacgtgaatcttatttgtgaagaaaaataattggaaatacagaagagtaaaactaaactcatttgtactgatggcaaaaaaattcagtgattaaaaaaagttctgattcatgattcacattcaccgtaacgttttgatttttcaaatgctcctgttgttttagtatgactataatctttattttttcacaatttgatttttcttttcttttctttttttttttttttggaaacagggtctcattctgttgcccgggttgggtggaatacagtggtgcgatctcagctcactgcaacctctgcctcttaggctcaagcaatttgctcacctcagcctcctgagtagctgggactacaggtgcatgtcaccatgcccagctaattttttaaattttttgtagatacggggtttcgtcatgttgcccaggctagtcttgaactcctaggctcaagccattctcctgctcagccttcccaagtgttagtgtaacaaacatgagccactgtacccagtctatgctttgtttttaatttaagcagtattattcatcttatttactcacttcattaggtacacttaattttgaaggagtttgttttttcaaaaatcaaactacttttaattgataaagcttgaaaaacagagtctcaggctccgcagaaagatcctgaaaagatgtttcaaaaatcttttaaacattttgactgctttgaaggggggtgtctaaatttgaatatgtaagtacttgtattggcgatgaagtaatctttttatgtcatagctatttttaatgggtgaaaatgtttctgttcatagacagtcattcttttcataggtcatagataattaaaataaaagatttttaaaatacaaattcactacataatatagctggtaatattctttttttttttttacataactcaaggtttataatatatagacatttacacagaaatttttggccctaattcatatataactcatcatcttttaggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataaggttgggagatagtttgcttttattttatttatttattttttattttaaaaaaatttttgactattataaaaccagattgcttttatttcagagttgctataattactatcaatctgatataggcattttagtatacaaacagatcactcttaaaaagcaggaatgaaatataaagtctttttcattttcacttaatttttttattgagataaaatgtacatacataaaacttaacatttgacagtttttgaagtatattgttcagtggcattaagtacattcacattgttgtacaaccatcaccaccatccctctccaaaacttttttcatcttcccaaattggaactctgtgtctatgaaacaattaacttcctatttcccttctcctcagcctccagcagccaccatttactttgtctccattaatttaaccatttgaggtacctcatataagtgcagtatttctccttttatgactggcttaaatcacttggcattattcaaagttcattcattttacagcatgtgttagaattttctccctctttaagctgaataatagtctattgttttccatccacattttatttatctatttatccagtgatggacatttggatgcttctaccttttggctattgtgttaatatatttatcaaaagataaataggctgggtgcagtggctcatacctgtaagcctaacactttgggaggcccaggaaagaggaccacttgaggccaagagtttgagaccagcctggcctatatagtgaaaccctgtctctacaaaaaataaaaaaaattagccaggcatggtggcacatgcctgtagtcccagctactaaggaggctgaggcaggaggattgtttgagcccaggagtttgaggctacagtgagctatgatcatgccactgcactctagcccagatgacagagccaagaccctgactcttataaataaataaatagataaataaaaggtaatcattagcattttttcagttctgttggtatttgatttctatctcaaagatgatatgaggaatcttattaaagggttattataaatgtatggttttatgtattttgaattattctgtaaccaggtatttgtagatgcatagtgtatgtctttttccattggtaaaaattgatctatactgtggaaagatgaaactttattatttttctacaagctttttttcccttcttctcattgccttcccacattttaaagtcatagatctttagcatagaaaagatatagcagtagatgagtttgttttttaaaaaaagttatagtctgcttggtttaaccaaaagtaatttaaaaattaataccacattaaaaagctatttcaaaagcaatatgaaaaggaggattattttttattttaacatattatttgggctgggtgtggtggctcatgcctgtaatcccagctgaggcgggcagatcacttgaggccagtagttcgagaccagcctggccaacatggcaaaaacctttctctactaaaaatacaaaaattagccaggcatggtggtgtacgccagtattcccagctacttgggaggctgaggcatgagaattggttgagcctgggaggcggaggttgcagtgagcccagatcgtgccactgcactccagcctgggtgacagagtgagattctgtctcaacaacaacaacaaaaaagtattgtttgttaaaatggtaccttaattcactaactactgaaccattagtatgttctctccaaagctccctgagtttttctgagtatcagatttacttgagtatcaagtggcctggctttagtttataaatttacattaatcagctttgttactttaattaaagtattttgttacattttccctcataaacatggtaaaataaaatagcctgacatactaacttagttagtaacatatttactaacatagttttgtaaaaaactatgttagttttggaggccacacactgatctttatatgagattctatggccatattgttttcctggtagttatggaacctatttcctaaagtaaaatgtatttttgatcagtgattgtgcttttgaattgagcaggttacaattacagatgtgtgcttacttcatacaggtctagaattaaacataatactgtttatttccacctgatatatcaggatcaatcagatgaaatatgtaaggctttcttctgctaagggatagctttagaaataaggttgtgataaaccgcaagaggagcaatacattttgaggatgtcatagaactcatgctcttttgtttatgtattttagaaataattaaaattggccgggcacagtggctcatgcctgtaatcccagcactttgggaggccgaggcaggcggatcactaggtcaggagatcgagaccatcctggctaacacggtgaaaccctgtctctactaaaaatacaaaaaattagctgggcgtggtggcaggcacctatagtcccacctactcgggaggctgaggcaggagaatggcaagaacccgagaggcagagtttgcagtgagccgagattgagccactgcactccagcttgggcgacagagcaagactccatctcaaaaaaaaaaaagaaaaattaaatagcagtctctgtgcctaaagacttaatgtttcagtaatacctataaagcaatagaaaataaaacagcagcattttgtcattgttaaatatacaacttaaatattttaaatacaatattcttgtcacattaatagtgaataattaaaaagaaggacctacccaggacatttttaataatctgtaaatagattagagatactgtcccagtagcttccttcctaccattcagaagaattattcatgtataccacatagtaagccttcaatgacattctttggttatgaaatgaacaatctttaaatatatttgatataacatttagaaattttgagttctatcttgtttttaaatttatgtgtattttttaacagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggtactaaaattaattcttatacatatacagtgtgggtactaagttatataatatgggtataattggtattaatatatgctagcatatgttttttgatataagctatagtgaaatttctagattttatatacagaaacacttaagtgtttccatcccttccttcctttcttccttccttccttccttccattttgattccttccctgtcttcatcccaacaggatttgaggtagcttacaaaactatatatgaatatttgtttttcacagatattggttaacaattctgaaactatgtatatacagtactagtcttcagcaagtaagtaaatatgttgtataatgagagccagttttctcactattggagaaaggaaggagagaaggctagaatgaagtctgacgttttagattggaataagaggctccaactgtccaaacctgggataatttgagtagcaaaataaataatgattgtaaactattataacccatggaataaacaaataaacatgagtccatactgatataaacagatatttgagtaaataaataaatagggaagtgggaatagttcttccttatgtactaatagaatttcaatgaataaatgtagaaaggatgatggaaatgggaaatcagcaattagcaaacactatagtaattattattgcaggcagtgattattaatggatgctaaaattaataggcaaaagatgagaaacaggttatttgaagaatcttgaagtatctccctatcagatacttaacaattataaagggaaaagtatagtaactttacagtagagaaatataaatataactggtccgaactccttacaaatgtcaaagtaatgaattcccagatttgatgacattaaggagttgacatttgatgacaactaaatgtaatgtgtaatcctggattggatcctgacccctaaacaaagtgtgctagtgggacagctggtgaaatttgaataaggtcagaggtttggttaataatactgtaataataagaatttcctgatttgaataattgtactattgttacgcaagatatgaacattaaggaaagctgggtgaagaatatgtgggaactccgtatcattgatgcaactttttgtaacatctaaacttgttttaaaataagacgtttttaaagttcatatggtgtaatacattaaaaatgaatagatcaagttgtcaaagtgaagtagaaaataagtatatgttttcatacataatttgtatggtatttgccataacaaattactgcaaactaagcgagtttaaacaatagaaatttatcatctcacggttctggaggctaaagatacaatatcaagttgtcattaggaccatgatctctctgaaggctaatgttccttgcctttctcttaaccttctggtgttctgtggcttctggatgtattgtaccacattgcctttattgttacatagcattctctctatgtctctgtgtctctattttctcataagaacaccagtcactggattattgaattaagggcccaccttaatgactttatcttaacaacattacatctgcaaagatcctgttactgaataagctcacattcccaggtaccaagaattaggatttcagcatatttttttgagagataaagttcaatttataacattaagtaatactgataaatcactatataatgggtattgtgccaagtatgttatgtacattattttatttattattgttaacacgcctgattatccatccctattttatggacagtgccagagaacttacgtaacttgtctaagttcacagttgcaaaactgaaactcagagacacttgagtcagagttcaaagaacttgctgttgactattttatttatgagcatgacatattgtatatgtctgagtttggatttgaaaatatattttttcttgataatttgtgtcagtgtaaaaaatatatgtatatatacatatatattgatatgtacacatatatgcaaaataagttcattcatatgggacttaattttgagtcttgtattctggaactatttgatttcacaacactggttttaactgacattaattttcatcaataagaggcttcacttgggtaagtacggtggtccctccttatctggaggattgcttccagaataccctcacataccaaaatccacacatactcaagtctcagtcagccctgcagaacctgcatgtatgaaaagtcagccttcagtatatactgattttacatcccatgtttttgatccatgtttggttgaaaaaaatcacatgtaagtggacccacacagttcaaactcatgttgttcaagggtcatctgtattaagggaagataatgtggtttattattttattatacaatcagtaactttatgtatgcttaattgaaaaatgttcctttattcttgtttttcaataacaatttgaataaaagtagatgtttcttgtccaattttaacaaaaaaaactttgccccttttttcatttggctgatgtgattaatggatatcactcttccttgcaggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtaagttaccaagaatataatacgttgttatggttgaatgtttatttttaatattttagatttatattggcctcatatgtatatggatatttcataggcattgtgtttcttttaggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataaggtatgtgatatgagttactcttactaattgtgttttctctcaatttccttttctcaacaactgtatcttccttgacatacctgttagtagcagttatactcacagttgagttatactgagaatttgttgactagttttcatcagtggatcatgtagtaatgcgtattaggatggagagaacttagaagagtgatactgtaaagctagtactgaatttgaagtccaagagcataggtttaggttctgactcaattagttattagttatgtgaataagggcagatcagttcattttactgagactcagttttagagagacagagtagtttaatacgatagtttccaattctagcaacatatcagaattatccaagaattaaaaaaaaatttatagatacccaggagattcagattctgtaggtccagagtgggacctgggaataaattgaggcaattggacccatctttaaggccccctacaattttccaatattataatcctgcagggcagactggtaggttagcgcactattttcttcacctccatcatctacaggttgccttgtgctgtcacaagaaaccaagaaagatcatagatccaactgagaacaaatcagagataaaatactggcatgggttaaaccatacaagagaggaatttagggtaactgattggacaagggatgaaaggtccctagaaaaggcagattagaggacagcagaaaatgaacaactggacttcattatatgacatgttttatttcctttatgaggggatgtgagcatctgacccttggctgcttctgttgttttaagatgaaagtgttaaagaaaagtagaaatatatgagaatatttgtatttcatattattcaagaaagacattaaagaagttaatatgagactaaatattgaatgcataaaatttctctgtaatactgcttattcactgtactaaactcagtgaaaggtaagtccacttatctcctagatcttatccaagatcaagtatggtttcagttctgtaaaagcaaaggcagagctacatggctccttcatgttacaaacttctaaagtaattacaacataaatattttgagggtatttttgctttttgctaaaagaatctggacatgaagttctttgagtaaagatttttaaattctaacattgttagtttgtaataaaatgtattgtttctaagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgaggtaatcacctatactttgtaaataatttaacagtaacctcgaatataattattggcccctacatatgtttgtttttatgtagaaaccactttgtactgactgaaatagtttttttaaataatagctttatgcagatataatttatataccataaattcacccctttaaaagtacataattcagtggtttttagtatattcacaagattgtgcatccattaccactatctaattttaaaacattttcatcagcccaaaaagaaattccgtaggcattagcagtcactcctgatcccttccccctcccacccctgctatctacttgtaaccactcatttataatattttctgtctctatggatttacctattcaggacatttcatataaatggaatcatctaatatgtggccttttgtgtttgtcttctttcacttaatgtaatattttcagtgttcatcatgtatcagtacttcattgttttttattgccaaatggtatcctgttatatggatatactacattttctttttctgttcatcagttaagagacatttggattgtttccaccttttgtgtattataaatagtgtggctgtgaacattgtgcacaagttttatgtggacatatgttttcagttctcttgtgtatacctgggagtggaattgctgggtcatatgttaaatgctgtacttaacattttgaagaactctcaaatcattttccaaagcagttgtaacactttataatcccactagtaatgtatgtgggtttcaacttctctgcatcttttctatctttagataacatctttatctatcctggttattgtctgccttttttattttagccattctagggatgtgaagttgtatctcattgtggttttaatttgcacttccctaatgaccagtgatggtgagcatcttttcatgtctttgttggccatttgtagatcatctttggacaaatgtctattgaaatcctttgcccacttttaaattgggtttttttattctttttttttttcctttgagacagggtttcgctctgtcacccagtctggagtgcagtggcgtgatcttggctcactgcaacatctgcctcctgggttcaaacgattctcgtgcctcagcttcctaagtagctgggacagcatgtgtgcatgagccactatgtctggctgattcttgcatttttagtagagattgggttttaccacgttggccaggctggtcttgaactcctgacctcaagtgatcctcccaccttggcctcccaaagtgctgggattataggcatgagccaccatgcctggcctattcttgagttgcaagagtttgtttctttgtttgagacagagtcgcccaggctggagtgcagtaacgtgatctccactcactgcaacctccgcttcgtgggttcaagtgatttccctgcctcagcctccccagcagagaaggggttttgccatgttgcccagactggtcttgaactcgtaagctcaagccatccaccttcctcagcctcccaaagtgctgggattacaggcatgagccaccccgcccagccaagttgcaagagttctttacacattttggatacaagaccttttaagatatgattttcaaatattttcttccatctgtgggttgtctcttcactttctttgatgatggcctttgaaacataaaagttttaaattttgatgcagtctaatttgtttttttcttctggttatttttggtgtttctgttgtcatatctaagaaactattccctaatccaaagtcatgaagatttacacctatgtgttcttctaagcatttttgacttttagctctgctatttaaatcttttatctgtcttcagttattttgtagatatggtgtaaggtaggggtccatattcatttttttgcatgtgcatatccattagtcacagcaccattttttgaaaagaatattttgcccctcgtttaattatcttggcttttttgttgaaatggtcaattgattttcagcaatattctgttgatctatatgcctaaccttatgctaacaacacagtgttttgattgttgtacctttgtagtaaattttgaaatcataaagtgtgagtgttccaactttgctttttttcccccaagatcatttagctattatgggtcccttgtatttccatattaattttaaaatcagcttggattttgataggaaggacattgaatttgtaaatcaattagggagtattgctgtcttaacaatttgggagtattgctgtcttaaccatgttaagtcttctgatcgatgaacatagaatgtttttccatttatttgaattttatttttttcatcaatgttttgtggtttttagggtcaagttttatatttaacttttaaaaattgtattcctaagtattttattccttttgattttattctaaatggaatttttcttaatttcatttttggattgttcattgctagtgcatagatatataattgatatttatatattgatattgtatcttacaatctgctgaattcatgtattagttctaataattatttttgtgccttccttaagattttctctccacaataacatgtcacctgcagatacagtttttcttcttcctttttaatatcaatgccttttatttctttttcttgcctacttgccctaactaaatcagtgtcgaatagacatgctaaaagtggacatccttgtcttgttcctgatcttaggggtagagcagtcagtctttgacttttaagtatgatgttagctgtgggaaacagattgtttgaaaggacttttaaagcttatttattcaccttcattatttaaaagctgtctatcgggccgggcgcggtggctcacgcctgtaatcccagcactttgggaggccgaggcgggcggatcacgaggtcaggagatcaagaccatcctggctaacacggtgaaaccctgtctctactaaaaatacaaaaaattagccgggcgaggtggcgggcgcctgtagtcccagctactcgggaggctgaggcaggagaatggcgtgaaccccagggggcggagcctgcagtgagccgagattgcgccactgcactccagcctgggcgacagcgagactccgtctcaaaaaaaaaaaaaaaaaaaaaaagctgtctatcagacattatggtagaatactggttagttggacatatgcaaaagcaaattctctgaaataggaagtatatcatcatgtggaacagttaccaagagcccctgtgttagtctgggtcagtcaagaaataatttctggaggaagtagttgagaccttaaaagttaataaagttgaccatgcaagggagaagagagtgttctgagtgataaaaatatcaaggcaagtgaagtcatggcctgcctgagaaatacagtatgtattccagagggtatacttccaggaggtggtgctaagagatgacgcaggacaggtaagcaggggctagattatgaaggtctcacatggggcctgttactacattataactttgcctgcagagcaaccagaagtcattgaggattttaagaaggaataaaaagggggcaaggggtggaaagagataatctgatttgtactgtagaaaaaatagggtcctagtttgggccaacagccagaaaactagttagaggtttattgcagtaacccaggaaaggatgatggtgtactggatagtgtcacggccgtagagacggagataactgaagagattccaaagagatttaggagttgtaattgcatgttagaggaagacggggtgaggatgattcctagatttttgtctagggcaaatgggtggatgatgatttggggaatacaggagaaatagttgggaaaaggtaattaattttattttggagatactgagtttgaggtgtttggaacatatccaactgggtatttcccataggtaattggatttgatgtttagggtgcagaaaaaaggtctgggctaggtctatatggtagctatagatgttatatcgttattgaagacatggtaagggataaaattccttcattcaaaatatagtcatttaccagttcacagtatacacttagagatggcacatagaacccatcttactctattctccaaaacacctctgactcccctctatcttgccttttttcctgccttcccttctcttaccctcccctcacaccaaaacagaaatttcacataacttaatgaagacgtagtaatgtgtattataagagtattaccattagcttctcatccttcacttaaatattgatgtcagcaagatttcttcttgcaaagataacatcataccataatatttgtttcaattttagtgtcttaaagacttttctacatgatcctcttgtggaatggagtaaaccagtgaaagggcattccaaagcgccactgaatgaaactggagaagttgtcaatgaaaaggttagtagaaggtatagcttgatatgggctgtagtcctcatctctacaaatgaacttgatatgcagctatagttctcatctctatgcatgagaactgcttggaaatactgttagtgactattgattactctgaaatctagttctctagtatcacaatgccataagttttctttattgtcagtaatgttaacagtattcgcatttgtataataaaagttcatggcacacttgtttaaccatagacaattcacagttatgagatacagtaggaaaaactatagtacaaattgcctgaacttacagaacaacaggtctgagctttaatatcatgataccagtatgtcacaagctatgttaacaaatgcagcaattcacttcttacttagttgaagctgcaaagtttgcagatagttttgttgttgttgttgtggtggtggtggtggttgttgtttttgagacagagtctcgctctgtcatccaggctggagtacagtggcacgatcttggctcacggcaacctctgcctcctgggttcaagcagttctcctgccttagcctcccaagtagctgggattataagcgtgcaccaccacagctggctaattattatatttttagtagagatgggtttcaccatgttggccaggctggtcttgaacccctggcttcaagtgatccacccacctcagcatcccaaaatgcagggattataggcataagccactgtgcctagctcagatagttgtttttaataagttagaatagattgaggattcgttttttttggtggggggcactcttacatctttaataagtcttgtacaggcttactaaatacaatgaattataccaactatatgctaataaagattaaaaatttacattccagttaactacctaaagagtttaagtccactttcatcctactgatatagctcgaggaaggctagacctgtacgcccccatccttcatgtcatccttaaccctttgtcttgagaaagaaggtttagctgcttctttagttcttctaaaagaactaaaagaaaaatttctttttcttgctctattatcttcatctgtagggtgagattaatatttccagaattgtggaaaaattcactctgtagcagttgaagagcagatggtctctgggacatgttccttttcgttaagtgatagatatacttggcttgtactggataccttttactgagggattccaatatctgaccagttcttgaacctgttaaaacttctgctcgctccatttctgttctaaacagctgaaagagctctagcaggatcacactcaagctatatacatatctaactggacaaagccagccctggtctctacaaatagtttttgtttttttttaattagctgggctcagtggcacactcctgtagtcccagctacttgggaggctgaggtgggaggatcacttgaccccaggagttggaggctgctgtgagctatgatgacaccactgcactccagcctgggcaacagagtgagacccttggcatcatactcagatccttccaactgctgggatgaagcatacagacaagtgcccactctggatataggtgttggtgttctctttctgtttctatgggtccagtctgtgttcttttgtaagatgtctgggcaagccagaccaaagtctcctatttttacttgctgatcagggccatgaagaaaaatatttctaggcttcagatctctgtttacaatacccatgttatgtatgtaaaacacaccttccactaaatcttgaaaattttttgttgcaacactggccataaggacaggcaaacttgcccacacactcttggccctgtttgtttctctcagctagccagtcccacagctggagcttgcacacctgcatctggatgtgcagcatcaggtggtactgcacctcgatccccaacaagttgaagttttctttggaagattcctcagtggatgtgaaattctcctctaggagggaattacacctgagcagcaggggctgtttcacaattgaccaggtagacaaaccagccaggccattttcctggagctccagggatgattcatattcactggtgtctcttaagacggaattgatggtgtagttcacagcttgttgttctgattttgagtgtcagattctgcaaagggtttttcttttctgaggtgagctccgcgaagataatgggtgagctgctattttcaccatttttaacaccgtattggtatctgtctgcttggtcggagaacacttccagaaatggcaactgaacggaagctctgtctgcttgtggttggaccacttgaacatgttctgtccacgcagtgtgataacgaatgatattagggtgctgaagacctgccagcaccttcattccccgtagttctttcatgtaatgtgtttttgttgcacccttaatcaggattttttaaattgcataatactgaccatctaatttattcctgaccttgtatactcttccatatccaccttttcctaagatggcaagttcttcaaattcatttaagtaacgtgaagtttgtgcttcaaagggtacttcccttgatctgattttctggatatgagaaatagcctcacaaggatcctgatgaactctctctttagtggacctcattaagtgagtaatagctctgtggtgatgtagtctcaatgagctaaacttgtcacaagtgaaagaagacagcagccccattttgataaaggtctggcaaagtaacttaaacactgtcttgaatgaactgggtttggttcacgcacatggctcaagtgcttcaccaaagaaataagcggcagctggtttgcaactgcaaaagggaaagttggctgttgtaggggttattttaatacctggagttctgctggaacataagtcatatttggagtccaggctcttggcggaaaagtcgatggcagatggcacagcaacagtctccaccccgtggccctcctctttgtgctcgtgggctgcagcgcagcccaccagcccacccagcaccacctctgagaattattcttctaataacgttattcttccttttgcattcagatatgcttaagaaattgtacagttccaagtagctcacttagaacacccatttgcatgtactaacataatgtaaatattaggcagtacagcattgttatttgaatattcattgaaatgtttaagtcctaaacacttccaaagcagatttaaaaaattatttttctagaattgtaatgtgtaaataattccctggtatttcacgtagtccagaaacatgtccaagcagttgatgttgaatcaatcttgcgagcctccaaatcagtatcacaagctaactgtatttgtttaatttcttcttttcctgtatttgctcttacaaaaggggtattggtcagtaaaatggtattaacatttattaaatgtcaaaatataaagaaaggtagtaattccaaattattaacatctgtttttggttttatgtttcttctttttaggccaagacccatgttcttgacattgagcagcgactacaaggtgtaatcaagactcgaaatagagtgacaggactgccgttatctattgaaggacatgtgcattaccttatacaggaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaataca

SEQ ID NO: 35 - DNA, 75502 bp, Homo sapiens
ggcctggcgggaaagtcgaaaactacgggcggcgacggcttctcggtgagtaagtggagcaatggtcgtagtctctcgaggccccgctcccctgcggcctaatctctaagtccgggccgcggtcggcgttctcctctggggctccgcgccccgaaccttggcttcctcatctgccctgagatgggataatccccacaggtacctttctgcgtcattaaaatgcggaaacgagaaaggcttttaccctcacccgcttcccgatgaactaatccaggcagtcggcctcatctcacttctgttgggcttttctggaagccagatggtatcgcacgtgttaaaggcgggtgcctggaagccggacgtgctgacaagacttagtttttccatctgcaagatggctgataatggttatccgtattaaccgaagcggcgataaataaaaagtttagcacagggcccggtacctcgtaaatgttaaccattattagaagtcattataatcatcaagagtaagtataggtggtgaagagcgcaggtgctgaagccagactccgagttagaatcccagttctgcccgtgatgatgagaataatggtacccacctcaaaaagttttgtgggaaataaatgaattattaaatataaagcacttgaaacagttcttgttagcttttagcatttcccctgcactgcgagcttttttcactctgaatattctcagaaattttccttatgccggtaactatgctgggcattagggacattgagtaagtgagactgggttcctgctctcaaagagccccagtctagtgtgaggtaagggcccctaggtataccctgtggagcagggaagctgcagtagcaaactcccttagggataggaggaacacttttcaaggaagatgacattcgattgaatgtttagatctgagtaggaatttccaggcaaataagagcacttcagatgaaaagaacacctttgtgcaaaggcactgagaccacgaaggttctgatttacaagattaaaaggtcatgtgattcaggcacttcccccacctctgctgtctgatttctaactccacatctccttgtttcagtatgagtatctatttgcctggactcctcttctcctaccccttctactggctaactgctgtttcagccctcaagtccctgcctaaaaatcacttcttcaggccgggcgcggttggctcacgcctgtaatcccagcactttgggagtccgaggcgggcggattatgaggttatgagatcaagactatcctgggtaacacggtgaaaccccgtctctactaaaaatacaaaaaattagccgggcgtggtggcgggcgcctgtagtcccagctacttgggaagctgaggcaggagaatggtgtgaacccgggaggtggagcttgcagtgagccgaggctgcaccactgcactccagcctgggtgacagagtgagactccgtctcaaaaaaaaaaaaaaaaaaaatcacttctttaggccgggcggctcacacctgtaatcccagcactttgggaggccgaggtgggtggatcacttgaggtcaggagtttgagaccagcctagccgacatggtgaaaccctgtctctactaaaaaaaaaaaaaaaaaaattcaaggagattgtccctaagaaatggtccttgcttctctttaccacccttactagcaactagactaaatttcctagtaagccctcatagaacctgtacttttatagcacttacataactgtagttcagtacattaaggctatttgttaccatactgtaaattccctgaggacagggatcatgtctgtctagttcacagttgtaaccccagcacctagcacagtccctaacatatagtattgaaatcatgaattaaaggacaggtacgttggggatagataatggagggtcttgaatctcagatggagagtgatgggttttatccttcagcaacagcgaagtagtctgcctaaagaggtaactaagacttgaaaggaaggtagtattggctagatgtaagagttgaaatttgcttagcacctaggtttaggtagcattaatatggagatgtgagcccctctgattttggatagagcagttttctttgaacaatagctttaacttctcagaatttatcttctagagggtaacttctgtttcccgattttgctctaggaagtaatttaagtgcacaagacattggtcaaaatggtttccaaaagaagactgtcaaaatctgaggataaagagagcctgacagaagatgcctccagtaagtatctagtcatttgttgctttatttcctgtagcaatgtgtgaggcatgtgagagatataaagttcctgcttttcaagtgctgagaatcttcaaagtgtaatgaatggagtgcacagaattaagggagaaatatcagatttgggactgagtttttgcctcgaattctgcgtataactttgagtatgaccacagcctctggacctcagtctccacatccataagaggaattagtgttacagactttttctgctatacatcatttaggtgttgagacacaaagacataacatagtctgtacccttaaaaaactttatggtctttcttcctctcttggaaaaaaaatattatgatctagacacatgctatgttagtgatgtgaaaggaaaaatacatcaaagcaagcaaaccagaggcaaagaaacagtgcagactctgcccatatgagaaatagttgacaaagatcccaagagttccagatataaggagttgatggctgggtgctatcgctcacacctgtaatccaagcactttgaggggctaaggtgagagggtcacctaaagctaggagttcaagaccagcctgggtaacatagcgagactccatctctacaaaaaatttttttaattagctgggcatggtggtttgtgcctgtggtcccagctactgaggaggctgaagtggaaggatcacttgagctcaggaggtcgagggtgcaatgagtcaataacagcaccactgcactccagcctaggcgacagagcaagagagaccatgtctcaaaaagggagtggggggcggggaggttgatagttcatttattgctcttatctactctattaatcttgatttgtgttggtttgtttttattttactaggttttttgggaacaggtggtgttcggttacataaataagttctctagtggtgatttctgaaattttggtgcacctgtcacccgaaaagtgtatggtgtacccaatgtgtattttttcaatccctaaccccccttccaccctttctcttgagtatccaaagtccattatatcattcttgttgttgttgttgttgttgtttgagacggagtctcactctgtcacccaggctggagtgcagtggcacaatctcggctcactgcaacctccacctcccaggttcaagcgattttccagcctcagtctcccgagtagctgggattacaggcgccagccaccatgcccggctgatttttttgtatctttagtagagacggggtttcaccatgctggccaggggctgtctggaactcctgacctcaagtgatccatccatctcggcctcccaaagtgcaaggattacaggcttgagccaccacgcctggcccattatatcatttttttttttttttttgagatggagtttggctcttgttgcccagtctggagtgcagtggcacaatcttggctcactgcaacctccgcctcccgggttcaagcgattctcctggctcagccgcccaagtagctgggattacatgtacatgccatcatgcctggctaatttttgtatttttagtagagaaggggtttcaccgtgttagtcaggctggtctcaaactcctgacctccggtaatccacccacctcagcctcccaaagtgctgggatatcggacgtgagccaccatgcctggcctcattatgtcattcttaatgcctttgcattctcatagcttagcttctactgacttgtggattgaagagttatttcttactaggttattggaagttaagtctgattcttggtcaattcaaccgaaatagatgaaaatgcttgctgaacagtgattataatgataaaaattgtgagtccaaaaccatgtaaggaataggcttgatttagaaacggaaactgtgggccgggcacagtggctcacacctgtaatcccagcactttgggaggccaaggcgggcagatcacctgaggtcaggagttcaagatcagcctggccaacatagtgaaaccccatctctactaaaaatacaaaaattagctgggcgtggtgtcacgtgtctgtaatctcagctactcgggaggctgaggcaggggaattgcttgaaccccggaggtggaggttgcagtgagctgagatcacgccactgcccttcagccggggcaacagagcaagactcttatctcaaaaaaaaaaggaagttgtgaagctccaatggttgattagtaatggggttctagaattagaatatagagaaattggtagaaaatttgaaactgaagaggaataatataggaaattactgaaagtaaatgttatactttggaaatactgttctccaaaagagaagagacttctgaattaagtttattagaagggatttgggttctcttggtcagtaatgaacaaactgaaactttcattctggttgtgttttacatttcattcaggaaggtagtggtctttgtctcattctgattaaggctttattagaaagagggaaaggaggccaggcacggtggctcacgcctgtaatcccagcactttgggtggccaaggcgggcagatcacgaggtcaggagattgagaccatcttggctaacatggtgaaaccccgtctctactaaaaatacaaaaaattagccgggcgtggtggtgtgcacctgtagtcccagctactgggaggctgaggcaggagaatggcatgaacccgggaggcggagcttgcagtgagccaagatcgcgccactgcactccagcctgggcgacagagcaagactccatttcaaaaaaaaaaaaaaaagaaagagggagaggaattgaagaaggaaaaaacaaaatggcatcattaagggagaagagtaaattttaaacttggcttcaagtacctgtttgtttcttgtttcttatttctttttatgggttgaaagtcttgggattaaacctatctgagcattgtagtcaaagatatgatacaaagaaccttccccattctgtctaccctttattcagatcattgagtctcaaatttggtgtgtatcaggattattatctgaagaacataaaaaattcggattcctaggtcccattcccaagattttgactcagtaactctggtatatggcatggaatatgccttttttttcctttgagacagagtgtcactctgttgctcaggcaggagtgaagtggcgcgatctgggctcactgcaacctctgcctcccgggttcaagtgattctcctcctcagcctcccgagtagttggtattacaggcgcacgccaccacacccagttaattttgtatttttagtagagatggggtttcaccacgttagccaggctggtcttgaactcctgacctcaggtaatcagcctgcctcggcctcccaaagtgctgggattacaggcgtgagccactgtgctgggtcggaaatatgcattttaataagcttcccagggattccagtacagtggtttgcaggcaacagcttgagagacactggctagtttagtatttgggtggaaaacatttctgtgggttattcttgttaggcacttatttgtttgaatttatttttttagagatggggatttcactctgtcacccaggctggagtgcagtggtaatatcatagctcactatagcctcaacctcctgggctcaagttattcttccgccttagcctccgaagtagctgggactacaggtgtgcgtctcctcacctaactagtttgtgtgtggagggggggaatgggggtgaagggggggagatgggggggtggtctcactttgttgcccaggctggtcttgaactcctggcttcaagtgatcctcctgccttggcctcctaatttgctgggattaccacatgagccaccttgcctggccagaaatggcacattttgaattcttcaaatgaaaataggtgaaaataattctatttgtttgttttggaagccactattgctgaagacagtttatttcactacagcatcaatcctagtataatttttaaggacacatcagttttcctctcatgattattattcctgggtttaagttttaatttttcctttactatttgccatattcttgaaaatttttctattttcagaaaccaggaagcaaccactttccaaaaagacaaagaaatctcatattgctaatgaagttgaagaaaatgacagcatctttgtaaagcttcttaagatatcaggaattattcttaaaacgggagagagtcagaatcaactaggtaatattttaatctaattttattctctgggtttaatgaaatagttcaggactgaatcatgggttttctaaatagagaggcaatgaagattagaaatcagagggccatccatcttgagacaaagttgaaattgctttttagaaaatggtacagtcaggccgggcgcggtggctcacgtttatcatcccagcactttgggaggctcgaggcaggcggattgcctgagctcaggaatttgcgaccggcctgggcaacacgtctctactaaaatataaaaaattagccgggcatggtggcatgtgcctgtagtcccagctgcttgggcgcctgagtcaggagaattgcttgaacccgggaggtgaaagttgcagtgagtcaagatcgcaccactgcactccagcctgggcgacaagagtgagactccatttccaaaaaacaaaaatggaaaaagaaaatggtacagtctttggtcctcattactatgtcttaagtaaagcatttctcatccttttattagaaaaaatattatatattatttattttgtgttttcttatgaaaaaataaatatccagaaagcagctgtatcagtgtcagaataatttcagaagaaaatttataaagccatataagattctgttttgggggagcagattattctatcttgctaaggttatggcaggtcttttttagaacacttagtggctatctgctatcaaagctaagtcttttttttttttttttttttgagacggagtcttgctctgtcgcccaggctggagtgcagtggcgcgatctctgctcactgcaagctccacctcccaggttcacaccattctgcctcagcttcccaagtagctgggactacaggcgcccgccaccatgcctgactaattttttgtatttttagtagagacggagtttcaccgtgttagccaggatggtcttgatctcctgaccttgtgatccacctgcctcggcctcccaaagtgctgggattacaggcatgagccaccgcgcccagccaaagctaagtcttttatgtgggtttagacacaaccccatgactctgggctgggcacagtggcttatgcctgtaatcccagcacttgggaggctgaggagggtggatcacgaggtcaggaaatcgagaccatcctggctaacacagtgaaaccctgtctctactaaaaatacaaaaaacgaaacaaaacaaaaaaaaacgtgtctgtagtcccagctacttgggggggctgaggcaggagaatcatttgaacccaggaggcggaagttcctgtgagctgagatcacgccactgcactccagcctaggcaacagaacaaaactccatctcaaaaaaaaaaaaaaaaaaaaagatttgtctctgaaattaggttgaaaatatttttattggtttcatcaggcaagaaacttgggtttttagagaaggaaaactatggtaggaaactggtgaccagctcttcttttttctgcatagctgtggatcaaatagctttccaaaagaagctctttcagaccctgaggagacacccttcctatcccaaagtatgtatttttcccctggtatttttgcttgtgccagcataactctagaatttggaatttaaggacactggtataaagttgagtgggctagaatgatttttaacagcaaatattaaactaaaaattttattcttttttattttttaaatctccttaagataatagaagaatttgttagtggcctggagtcttacattgaggatgaagacagtttcaggaactgccttttgtcttgtgagcgtctgcaggatgaggaagccaggtgtggagaggaggcatggaatcttgctgaaattcagtctgttttgccaacttcatggggctggggagggagagcacagttgtttcaaatttcatttttggtgtaagctctgttttcctcagagtttaaactaagtttaaaattcctaagcttgtggttatgagcctaacaatcagtgttttacctatgctgacagaatttcaaatctctacctctcccttgcaaagagccatctgctcatttctgtatttcttgtctaacagggtagttcctctttaaatattatgtatttaaccaattttattgagaaaagatgataaaagcattaaaacaaggaaagcaaagtggaaaacagatttcttttttttttacagtatgggtgcatcttattctaagagtctcatcaaactgcttctggggattgacatactgcaggtaagactgtcactttttctgtgaacatttgatggaagaggtttgtggtgtatgctcaagtctaaatagcgggaacacaggatagagtagggttaattggagaatttgggtttgtagcagctttagcacagccctgttgctgtgatgggtttggtagggtaatgtctgtgttttaaaactgtgcttattagcctaatacatctggcggccccatttattctctctgcatctgattcctgttcttaaagctgcatcctgtgtatctctgagtatctggtaatctttatcatattcatatctacattatctcccatttagctttttagatgcttatgtaacttaattttgtccttttcctcctcctcgtctcttttattaagtagacaatacattgatatgatttaaatatctcaagttatacaaatgtatatagagcagaaaacttccctccaccccattctccatttttcctcttctcccctactgttaatcttttcacactcttaaactcttccttttcactggaaatcttgaagataatttagttattttaagtctaagagctcccttgttcctcctgagagctccccttgcaagttatttgataatcttttaaagtttgcattttgtggattaacagttattgtatttaataatattttaattatctgattattttaacgttgccttgataatcattttcagtttttcagaagacaaattaagtctttgtattccaatagcatattctaaaaatgaagacatattcgtgtggatatccttgtaataagatatcaactttagcaaagtgtttattccaggagctctagttggaaagagaattatacatttctttttttttttttttttttgagtcagagtctcctttgtcacccaggctggagtggagtggtgcaatctcggctcactgcaatctctgccttccccaggtccaagaggttctcgtgcctcagcctcccaagtagctgggattatacatttctattgtgtattttgagatcatctcctaactccctatgtcttcttttttagcctgccattatcaaaaccttatttgagaagttgccagaatatttttttgaaaagtaagtggcgttattatggaatgttcaaagtaccctgatgtacttaagttctctctgaaaaggttactctgaaaactattggtttctctgaaagtcatatttatcattatatttcttaagtgactactaaaattttactggagtgtctttgaagtttcatctattaatatgactttgtaaaaatagataggattactgttaaaagtaactattggcctggtgcagtggctcacacctgtaatcccaacagtttgggaagctgagggaggaggattgcttgagttcaggaattcaagaccagcctgggcaatgtagtgagaccttgtctgtatttcaaaacagaattttttttttttttttaagtatctgttgcttatgctcagggataatccctagtagaaggatacacaatatactggtaatggtagttgtctccaaagagggtagccagttggttggaatcaggtattttctgaatacttttctttaccttttaaattttgtagtgtatgttcagacagggtctcactctgttgcccaggctggagtgccgtagtacgatcatggctcactgaggcctccacctcccaggcttaagtgatcctcacacctcagcatcatgagtgcctgggactacaggtgtgcgccacccggtccagctaattttcgtggtttttttttttttggtagaggtggggtttcgccatgttgcccaggctagtctcaaaacttccaggctcaagtggtccacctgccttagcctctcaaactactgggatgtggccctacctgtttttttttaattactatgttaagaaatgaacagcctaatagaaaagtagacaaaggtcatgaacagacagtttacaaagaagaaatacaagaacatcaaatatttaaaaagttcaattttgttagcaatcaaaggcacaaatttaaaacactgtatcaaaatagtaaataataactattacacagtaaaataaatgcattttttcctactctcaaagggtctccttgttgagtgtagtgaataggcatgcttgtacgttgctagtgagcatataaattagttcaggcatcgattcggaagagcaatagattgtatgtgtcaaaaaccttagattttgcataccctttaatcctaatgtcatgtctcctcatttatcctaagataataactgtgaatgaaaatgaaataatattagtttagtgcttgctttggcagcacgtatactaaaattggaacaatacagagattagcatggcccttttgcaagggtgatacccaaatttgtgaagtgttccgtatattgaaaaagattactctttaaaataaagaaatgtaaataattgagatgttcaaaaaatagaaatattatgtgcacattaataattgtaaaaagaattagttaatatcatacattaattgaaaaaaacaaacccaggttacacatagcacttatattaggttggtgcaaaagtaattgcagtttttgcaataagtagttcagtattttgtttaaaaaagaagatacacacatacacatatgtatattaatagtgtacctttctggaatgacaggattatagtcatttttatgttctcctttttaattttttcagagtcctgatacagtaatagtaagtttaaaggtttacttattttgagacggaatctcactctgttgcccaggctagagtacagtggtgcgatcttggctcactgcaacctctgcctcctgggttcaagtgattctcctgcctcagccccccgagtagctgggattacaggtgtgcgccaccacacccagctaatttttggtatttttagtagatatgaggtttcgccatgttggccaggctggcctcgaactcctgacctcaagtgatctgcttgcctcagccccacaaagtgctgggattgcaggagtgagccactgcacccactgaaggtttattttttcaaatttgttttagctaaatgtctcatgctggatgctttacatcctggctagtctttttcagttaagattggctgcaataacaaggaccatgctgtcaaggagatggaagtggtccaaaactttagatataggaggctcgaaggaaggtggaaactatcatatttggaaaaatgataattgagccaacatttctttatttataaatgatttttagtacttttataaatataatctaatttgactttctatgttcccttagcaatatatgcttgcttttttttttttttttttgagacagagtcttggctctgtcacccaggctggagtgcagtggcacgatctcaactcactgcaacctccgccttctgggttcaagcgattctcctgcctcagcctcccaagtagctgggattacaggtacccaccatcgtgcccagctaatttttgtatttttagtagagatggggtttcaccgtgttggccaggctggtcttgaactcctggcctcatgtgatctgcccaccttggcctcccaaagtgctgggattacaggcatgagccactgcatctgacttatgcttgcctttttaagcacttactgcgttgatgttattagtgtcttaccttttaaaaatacttgtcatattcagtttttaagatttattaacattgtctttttaaaaattattattaagagatgctgtctagccctgtcatcccttctctctaaatcctccctggatgtagtcactgttcatatttagcatgtcttctagacatttttcttaacatacgtaagcatgtatctcctgcatcttgggtatcacttgtgtgtctagtgcagtgccgaatgcatagtaggtgttcggtaaatgttaatggaatggctaaaatattttgtgcagtattaatgcttgctgttattttgaccagaaaggctcagttccctgttttctcttcctaacattttagcaagaacagtgatgaaatcaacatacctcgactcattgtcagtcaactaaaatggcttgacagagttgtggatggcaaggtaggcttatggactttatctcttgaatttaaagagtatgtttctcatatcttttggaggttgtatttttttttctttctaaacagaaaattcatacttttccatccatccattagctttttccaattttcataatttgagaatcatagatacttcaccctttaaatttcagaaaagtttaaatacgaagagtagatatcatttattaaataaattaaatatttgggaagattctttttcaaagtacagagataaatgactgtgtttatttctcaaataatttcagctctgcatttcacacgtaggtagtctttctttattctgggtaatgtgctgcagttctaatagtgtcttctactgcaggacctcaccaccaagatcatgcagctgatcagtattgctccagagaacctgcagcatgacatcatcaccagcctacctgagatcctaggggattcccagcacgctgatgtggggaaagaactcaggtggataaaccctctgtcatcatctaagtgaggctcagctatgggggttctatcactgcagtatgcaaagagcagtagtaatatggtctcttctatctaaaaagaggatgataccccccttcatgagtagggtatgggatttgacttaaaaaaaaaaggtatatatttgaatagatccacatactttctttttttttttttttttttctgagacagtcttgctctgtcgcccaggctggagtgcagtggtgcgatctcagctcactgcaacctccgcctcctgggttcaccccattctcctgcctcagcctcccaagtagctgggactagaggcacctgctaccatgcccgactaatttttttggtatttttagtagagacggggtttcaccatgttagccaggatggtctcgatctcctgaccttgtgatccgccctcctcggcctcccagagtgctgggattacaggcatgagccaccgtgcctggccccatgtactttcttttaaatggtatacctgttatgagcgtgaagtctggcttaggattagatatctaaatttggccagtggagaagttgaccatgatcccttaagtttcattaacttgttcttcagggggtccttaaccctggctgcacattaaaatcatttgtggagcctattaaacatctaccttctttgggttcctaggtgattcattctaatgcacagtcctgcatcagaccgcttgcggagacccattgcttactgtcattcatttgaaaaatagtaattggtagggaagtattgaagaaggggagaacaatatccctaggtaataaagtttccatcttaatgcaactttttattgtactagaagtattttttttaaattcagtttgtaatacttccttttgtatagttgtctgcaaagctacctccaaaacatccagtgatttcttgccctcatccttttgggcaggatgctccttctgggcaaagtactacgccatccactttacctgcctgatgccagctcatctccttttgtatagtctttttttttttttagcatctgtcaccgtctgttgggcgcagtggctcatgcctttaatcccagcatgttgggcggctgaagtgggtgggtcacttgagcccaggagtttgagaccagcctggacaacatggtgaaaagccgtctttcaaaaacatacaaaaattaggtgggcgtggtggtacgcacttataattctagctactcaggaggctgagatgggaggatcaattgagcgtggaaggtcgaagctacagtgagctgtgatgacaccactgtaactgtactcaagcctgggcatcagagtaagaccctgtctcaaaaaacaaacaaacaaaaaaaaaagcaatctatcactgtccttctcactatgttgtgctcctgtagcaccacctacatgtgtctctcatacttatcagatttcattgtaaatgttttgggttttctttttcctttttgcggggaaggatacataccaaactaaatagtggtgttctctgggtagtggggattgtgatggaaggcttcttgtttctacttttattatttgaatttttataatgagcatgtattattttttgcagtcaaaacaatttttaaagaaacatactataaacggtaacttaatggcaactaagtatgtcctttattttcatactctaataaatgattttctcaagtcattgtctgcccagctctgttcaaaccattatacaacttttttctttttctaccattcacagtgacctactgatagagaatacttcactcactgtcccaatcctggatgtcctttcaagcctccgacttgacccaaacttcctattgaaggtagaaaagactcagctttccagaaacagagccagctttccaacctcccagaacaagtgtcagtcagtcattgccttgggagtaatgaatatttcattttgaaaccatagtgaatcacatttgatatctctctttttttttttttttcccctcaatgagtttcagatgctattctatggtagagtcacaggtctgtttttttttttgagacggagtatcactctgtcacccaggctggagtgcagtggtgcaatctccgctaactgcaacctctacctaccaagttcaagcagttccctgactcagcctcccaagtagctggggttacaggcacctgccaccactcccggctaatttttgtatttttagtagagacggggtttcaccatattgtccaggctggtcttgaactccggaccttgttttccacccccctcggcctcccaaagtgctgggattacaggcttgagccaccgtgcctggcccacaggtctgtttttaagcagtaagttttgagtggaaatcttccatgttgtctgagtcatacctgcttcccataggaataatactttttatgccttactgtagccagttgagaatttaggctctaaatgtaagataatagctctgtttcacatttattgcccgtctatttttgatgaagctgtggtattaacaactaaaagattctaatttggggaaaaatctaaaattttgtttttccctaaattataagtgggaagatggagtaagagaagtgatttttttctaattttatctaacagttcagtacaaagttgaggtagtgacatgaaaacctattaagtttctgtgcttttaatttttaggttcgccagttggtgatggataagttgtcgtctattagattggaggatttacctgtgataataaagttcattcttcattccgtaacagccatggatacacttgaggtatgctcttatatcccatcacacctagataaagcaacttaagtgccaattgctcttctctgtccccagactaactgagaatactgactaatccggatagcattcagaggagagaatggagctattcaacagattcattgatctatataagctgctataagttacatttactcttcctgtgtagtacctcacagaattctgaaattttgggtatgatgttctatgacattgcattggctattctcataactctatttttcaaaatgtccaacatttaaatttttttcttcctcagtctttcaggagattgtcatggtagagagactggactgtgcctacccactatgaatgagcagaaaaccatagctaatatttactttctgcaggtaatttctgagcttcgggagaagttggatctgcagcattgtgttttgccatcacggttacaggcttcccaagtaaagttgaaaagtaaaggacgagcaaggtaaagagctcatcctcacacaggatgtcacaattttctgacatcccactgtcagagttagagcttaatactactacaaataatgatactattatgacatttacatctagtattatattgtttttcaaattacatatatgtatgtgagtatgtatgtgtttatatattttcttagccattcagatcaatcccagacagacgacagtgcaagtttattagccatcttatacatgaggttgtcatttgctccagggtacatggcaggaactccgatcttgtaagttcttttctggtacgtagaagagtaatttttttcctctctgctacttgtagttcctcaggaaatcaagaaagcagcggtcagagctgtattattctcctctttgatgtaataaagtcagctattagatatgagaaaaccatttcagaagcctggattaaggtgagatctttggaactttgattatcaaggaggaaatgagtggcaattagtgacagatgtataactgaggtagactgaaataaaaatctcaaaactcattcaagtggaaatgatagctgatggttgccagatggacacattggctcttagatgagataacagggcatgctgaataaggtgtaacgtgtttcgctgatgtgtcataatatttttgtgactctctcctgttttttcaggcaattgaaaacactgcctcagtatctgaacacaaggtaatgttcatgtactatgcattttcagtattgcagacttaaaagtaatgacattggctagcttgccttcccactgtctttctttctcccccctccagtcactcttctctctcttccctagttgctctaataaacattagctgtctggggaagataatctgaggtggcgactggccagatagcctgcccctactcactctggctataaaataagcctacagtatccacaaggggaaatactaacagtgtaaacaagcacatcaaggtgcagtcaaagaagccaggtccccactgatgagatgaagaaaataaccacctaagtctcaggtccctgtatctgcctaattgcccttccttccactcagcaccactgtcaagataatggcattccatgttttactttactttgctcatgtagacctgactagagtaaatcaatctgtccactgtcaaggcagtggtactggatcttatgtctctattaattctagaaataccttccatcaaaaagccagatgattggccgggcgcggtagctcacgcctataatcccagcactttgggaggctgaggcaggcggatcatctgaggtcaggagtttgagaccagcctggccaatgtagcgaaaccccgtctctactaaaaatacaaaaaaaattagcctggcctggtggcacacgccactgcactccagcctgggcgacagtgcaagactccatctcaaaagataaaaagccggatgattgagttccttaggtgctgattggttgcctttaaagatttttctttggttggaatctgttttgtgggatttttgttagttttgttatccaattttgggatgattatcttaaaagctttcatgatgctgaataaagcaatgaaaattcagaattttttctggtgaaaaatatcaaagtactccaacacactgtttttggttttggataaacataaatttaccaccttggctgcctgcatacctatttttacatatttgtaatcattgtataaatataatttgtattcttacttttttttcttaacattttttctcctgtcataaatatttcaaggtctgcattgtcttcattgttatctttaatgactgtattctggtctaataactcagttttggtgtcctaagaagtggagcattcagttaagataagtagtaaaattttttttgttttttcttgtttgtcctgcttgcctttttaactgtttttttttttttcctggaagcatagactcaggttgccctgaatacacgcccaatgttttctctttttttgttttgttttgtttttgtttttgtttttgagacgggttctcactctgtcacctaggctggactgcactggcgtgatctcggctcactgcaagctccgcctcctgggttcacgccattctcccgcttcagcctcccaagtagctgggactacaggcacctgccaccacgcccggctaattttttgtatttttagtggaaatggggcttcatcatgttagccaggatggtctcaatctcctgacctcatgatctgcccgcctcggcctcccaaagtgctgggattataggcgtgagccaccatgcctagcatggcttattcttcctgatgactgtgtaatattccaaaaattaaaattactccatcataatttattgaacctttcctgtattgatgtattgatgggcatttatagtctttccaacttttcacaaagtaattttccttttttttttttttttttgagacaaagtcttgctctgtcacctaggctcgagtgcagtggctcgatctcggctcactgcaacctctgtcacccgggttcaagcgattctcctgtctcagcttcccaagtaggtgggattacaggtgtgtgctactttgcccggctaatttgtgtatttttagtagagacagggtttcagcatcttggccaggctggtcttgaactcctgacgtcgtaatccacccatctcggcctcccaaagtgctgggattacaggcgtgagccaccgtgcctggcctagtaattttcctagtaatactgaaaatacatactgtagttggcaacaaatacacgctggagttggcaagtgattgaatctttcttttaataaatgtcaagatgttcagagttacttctgtagtaatatcactttcatgcatattgctctgtattctttttttttttttttgagaatggaatctcgctctctcacccaggctggagtgcagtggcgcgatctcggctcactgtaagctctgcctcccgggttcacgccattctcctgcctcagcctccccagcagctgggactataggtgcatgctgccacacccggctaattttttgtatttttagtagagacggggtttcaccgtgttagtcaggatggtctcgatctcctgaccttgtgatctgcccgccttggcctcccaaagtgctgggattacagatgtgagccactgtgcctggcctgctctgtattcttaaggggtatcaatggttaacagttgtggcactttatttatctgaaaaatatttctgagttttgtgaaaagtgtagatactcccaggggagtgtgtggaacaaatgagcattatccattctgtgttttaattagaggaaaagctgctgtttcattgtagcaaatgtactgatttgttaactgtttttctgttgttgcatatttattgacaataggtgtttgacctggtgatgcttttcatcatctatagcaccaatactcagacaaagaagtacattgacagggtgctaagaaataagattcgatcaggctgcattcaagaacagctgctccagagtacattctctgttcattacttagtaagtgtcagagactattgatttttaatctaaaacagaaagctttacagctctcatgtaaaatttcatcttatttcagtccattgttcaaacccattgagatttttgaattttgtttttgcattaatcattttaattgtctatctcaatgcagtttgcaactttgacaaactggccttccgtatcctatttaagtagcttataaaaaccttgaggggaataggaccagcctgtagaaactagtagaaatgtaaatatgtacctatttgaactatcactctttagccattcaaaactgtggactttaggtgataattcctctagaaatgtaaattattcaaagtggaattttataagctaggaatagtgttttgccagctgaacgttcaggatattagcagtatagaacttagaaaactggatgggccagtggtttggggtttgggttaggagctaatgagaatacctcgctgggtcttaaattttatatttaggaatagatttaacggttgtattattttatcttgcagttctttctgtgtttatttctgccaattatacatgttttgggctgtaattttctagatgcagaaaccacatgtaatttttcattgcattttccccaataaagcattatacccagcttagtactaaatataagatttttaaaaattatggtatcaataaggaagctatgtttattaactggttatttagtctgggtccattaatgtctatgtacattgaattattggtaggttatgatcacttctcttcttgatcttcttttaaaaaaatcagcttagttagcattgaaccttatagacctacttcaaattataaccaaggtggaacatccctgggggtagtatgattgcatggggaaactgggatttagaacatctggcctccaatcccaaattgagcagataggaatgttctattaggcttgtaatttaacttctttgagcttaaaagtcaattattatccaaacgtggaatcccattgatgctgagagtaatctcagaatgatgaaggattatttttgtgtaaaacaaagattaagatttcctaagttaaaatgagagctagggaggagaagtctgacattccaaaaggataagcaactcttaggttgtgtactaactgtttcctacagcttcttttctctctctactcttccccactcaaggttcttaaggatatgtgttcatccattctgtcgctggctcagagtttgcttcactctctagaccagagtataatttcatttggcagtctcctatacaaatatgcatttaagttttttgacacgtactgccagcaggtatgttgaaacatttattttggcaaggagggaacacagaaagggaaaataatctgatgtttatttcttgttggttggaactcactgaaggggaaggaactctgacctgggtctcaagaaagctcaattctagtcccagccttgatgaaaggaagagacttgactggtggctctaactctgtgttctgagctctaaaattctctgtctgaaattaagatccagatctagtccatttcaaaacatgagacacttttttttgttttgttttgagacgtggttttgctcttcatgcccaggctggagtgcagtggtgctatctcagctcactgcaaccttcacctcctgggttcaagcgattctcctgtctcagcttcctaagtagctgtgattacaggcacacaccaccacgcccggttaattttttgtatttttagtagacacagcgtttcaccatgttggccaggctggtctcgaactcctgacctcaggtgaaccgcctgcctcagcctctcaaagtgctgggattataggcgtgagccattgggcctggccgagacacattttaatagcatatatccagagagggaggactgtatttgtggaaaatgtttatgaaagcaagtaaagaacagtgtcttattttgtatttttacatatattcttcctgtcattaacaatgttaaaacgcatttgaatggaacttttaaaatgaagatttgtaaaaaaattttaaacatttaaagtagagcaatagttgcagctgacatgaggtagctgttgcagttgaaaatgtaattctgttatgactattatggagtgacagtataaagggagaatggcatctaagacatttctggaccctcttaatgtcttagagacactgtcataatccatgtttgcttggaaacatgcaagtctagcctgtactatatggagaaaacctttaaagcttttagctccttgagtgccatctttttgaggaatttcaactgatcttgtacaacctcaacctaaagggtaaaatttaacccatatgggaaaaagaaagaggaaaactacgccaaggagcaaaatcaggagggcttaggtagagctcactgataaaatatgggaaataggtcaagatgggatggtcaagttacactggcatattcctaaatctcctgaagccaacattaatgaaaactagataataggtgatgggtttgggttgattgtgattttaacaaagtagagattggagaggccttgggggtgaatccctttagaatggccatccatattttgttttacactgttctgttgactctcccctgtataggaagtggttggtgccttagtgacccatatctgcagtgggaatgaagctgaagttgatactgccttagatgtccttctagagttggtagtgttaaacccatctgctatgatgatgaatgctgtctttgtaaaggtatcttattggcttcttgtactttagatattgaatactataattggtgggaggtggtgggaaggaggtgagatgatgggcaagtaatataaataaaaagtgactattctatctatgtgttaattcattcagcaaacacttctttatacctaacctacaggctaatctctattctgggtgctgtgaatgtaaagtaggcccttacctttcatgttaaagactaagacacataagcaagtcactataaatacaacatggtgaattctctggtaaagtactatagatataacagagtaagaataattaaatttagcctgggaagctggagaattcttcaaagaggcaatgtgagtgattgctgaaggatgggaatgactgacaagagaaagtatgggaagtgcgttctaggcagagaagagtttgagcagaagcaaactggtgcccaagtcaatggtgtgactgaggaatgagaagcaaacaagcatgactggagaataggatatatatggagaggaatgattggaggcaaggctggtaagacataggacaggcccatgttgcaaagagtctcaaataacatgctaaagagtttcaactttattttttagacaataaggagctattactagtttttacatacagttgacctaatctactcagcattgagagataactcagtaggctatatgatgggtggattggagactgctgaaatggtctaagggagtgagagtaagggccagattttggtcacgggaatgtagaagaaattatggcttaagagacaatttggtgttagaattaacatgacttggtgactgttaagaatatgtggcggtccgggtgcggtggctcatgcttgtaatcccagcactttgggaggccaaggcgggcaaatcacgaggtcaggagatcaagaccatcctgcctaacacggtgaaaccccgtctctactaaaaatacaaaaattagccgggcatcgtggcggtcgcctgtagtcccagctactcaagaggctgaggcaggagaatggcgtgaacccaggaggcggagcttgcagtgagccaagataacaccactgcactccagtctgggcgacagagcaagactctgtctcaaaaaaaaaaaaaaaaaaaaaggcttagaagagcacagacattttgagaaggttaaagtttaagtggcagatgaaagcaaatgtccatagaaggaaaatgagaaacctggaagattaataatgtgagcttaaaggatgtcaggtagcaaaagcccaggaatgagtttcaagagtgagggattggccgggcacagtgactcatgcttgtaataccagcactttgggaggccgaggcggacggatcacctgaggttgggagttcgaatcagcctgaccaacatggagaaagccctcctctactaaaaatacaaaaattacctgggcattgtggtgcatgcctgtaatcccagctactcgggaggctgaggcaggagaatcacttgaacccaggaggtggaggttgcagtgagctgagatcatgccatcacactccagcctaggcgagaagagcgaaactgtcaaaaaaaaaagagtgaggccgggcgcggtggctcacgcctgtaatcccagcactttgggaggccgaggtgggcggatcacgaggtcaggagatcgagaccatcccggctaaaacggtgaaaccccgtctctactaaaaatacaaaaaaattagccgggcgtagtggtgggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaaaaaaaacaaaaaggagtgagggatttatctcccagtgttggacactgaaaaagttgaagatggaggcagaggctattggctttggcaattaggatacctctggtaacctctgagagaacagtgttaattgaattataagggtggaagccagagagcagtaacttgaagacttggggaatagagtcaatgtcgagaagcatcaaggaggagagaataaaaaaagtagcttgagaaagaagctggttgtgagggagatattttttagatgaggaggtttgagattgcttgtaggctgagagaaaggattcaatagagaggaagaaatggagatttttaaaaattaattaaaagtttacaaagctgttttattactttttcctcagacaaaccatgaaaggtagtatagctattattatcaccatgttatagatgagaaaagctgaggcatttcccaaggtcacaaagtaaatagtttccttgtgactccttccagatctgtagagaaaggagaaataattcattgagtagaagctgggaagggatgatatggcaaggaatagggtaaagacataacttttggtagaatattgttttcactgaaaaaaaagggaaaggtggaggtaaagaataccgagaactgggaggtgcattagaatgactaagcagtagatgattaaagcccaggattgtggttcagagtgaagaggataaagaaaactttatgtttcctgatagttagttcctagtctctgataataagagatttagaaagttgtaagaattttcccagtttatatccagtctatcaaacctttgggctctgagcatagcttttagaacttgagctttgagcttttaagggagctaaaaagttttagatacctggctatctatgtgtgtctcttttacagggattttaattttttgaattttaagggaaaaatgttagctgctagcctcattgttggcatcattttttccacagggcattttagattatctggataacatatcccctcagcaaatacgaaaactcttctatgttctcagcacactggcatttagcaaacagaatgaagccagcagccacatccaggtaagaggcaatatgttgggaaagatttttttttttttgagacagagtctagctctgtctcctagactggagtgcagttggcacgatctcagctcattgcaacctctgcctcctgggttcaagcgattctcctgcctcagcctcccaagtggctgggactacaggcacgtgccaccatacccagctaatttttgtattctccatcaaaaagtgggcgaaggacatgaacagacacttctcaaaagaagacatttatgcagccaaaaaacacatgaaaaagtgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacatatgtttattgcggcactattcacaatagcaaagacttggaaccaacccagatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccgcacaccgcatattctcagtcataggtgggaattgaacagtgagaacacatgggcacaggaaggggaacatcacactctggggactttgtggggtggggggaggcgggagggatagcattgggagatacacctaatgctagatgacgagttagtgggtgcagcacaccagcatggcacatgtatacatatgtaactaacctgcacattgtgcacatgtaccctaaaacttacagtataataataataaaaataaaataaaatagaataaaattaaaaaaaatttttttgtattctcagtattttgtattaattttaaacctcttgaaatttgctagaaaaaaaaaaacaagcaaatgatagatttcctagtgtgtagtagtggaaatggagtacatagccatagtactagcatttttttttcttaccacaaacattaagtgcctattctgtgccaggcactgatatattagatcctctgccctcaaaaagctttgtctgttagggtagagatgggtctgtgatcagctaaccatgaaactgttcagtttctgagtgcagtggggacacagaattgccttgttttctaagaaacatctccatctaatgtgaacttcacgtgggcttgcttttgtttgtgggcgccattcactgaaaaagccaggctgtaatcccagcactttgggaggccaaggcaggcgaatcacatgtgccctggagtttgagaccagcctgggcaccatggtgaaaccccatctctacaaaaacatagaaaaattagccaggtgtggtggcacacacctgtaatcctagctactcaggaggcggaggtgggaggatccattgagcccaggaagttgaggctacagtaagccatgtttgtgccactgcactccagccagggcaacagagtgagactctatctcaaaataaataaataaataaataaaacgaagagattagattggaatcataacttgtaactcgtttgtagctttagtgctaccttatggcagtaattcatactggactgtgactttgaacaaccagcatatatatatatatacgtatatatatatatacgtgtatatacatatatatatgtatatacgtatatgtatatacgtatatacatatatacatgtatatacatgtatatacatatatatatatatatatatatatatattttttttttttttttttttttttttttgagatggagtctcgcactgtcacccaggctggagtgcagtggcgcaatctcggctccctgcaaactccgcctcccaggttcccgccattctcctgcttcagcctcccaagtagctgggactacaggcgcccgccaccacgcccggctaattttttgtatttttagtagagttggggtttcaccgtgttagccaggatggtcttgatctcctgacctcatgatccgccagcctcggcctcccaaagtgctgggattacaggcctgagccaccgcacccggccacaaccatcatattttttatctttttttccccccctttcttggatccccagtcagcacattttttttaattaaaaaaaaaacttttggactaggtaatatacatgtgtcatacaaaattcaaaacatatagaagagtattcagtgaaaaataactctcacttctcagttctgtaggcacctggtttgtctcccacaggggcaatcactttataagcttctgagatgttctgagaatttacaaatttgtgtttacctgtagtttcctttcccttcttgttctacatcttagcttttgcatttagcagtttattttggagattgcttcaaatcagcaatataaaactacttcactattttattttatttttgaattttgataaaatatacataatataaaatagaccgtttaagctgtttttaagggtacaatttagtagcattaagtatattcacaatgttatacaaccattgccactatccatttctagaacttcctgatcatcccaaacaaactttgtacccattaggcaataatttgccatcttcctctccccaccccctaataatcactaatcacattctgtctatggatttgttcattctagatgcctcatataaatggaatcatacgatatgtatccttttgcgtctcgcttatttcacttagcataatattttcaaggttcatgtaggttgtagcatgcatcagaactttattcccattacagctataataattccattcttggccgggcacggtgactcacgcctgtaatcccagcactttgggaggctgaggcgggcagatcatgaggtcaggagatcgagaccatcctggctaacacggtgaaaccccgtctttactaaaaatacaaaaaattagctggacgtggtggcaggcgcctatagtcccagctacttgggaagctgaagcaggggaatggcgtgaacccgggatacggagcttgcagtgagccgagatcgcatcactgcactccagcctgggagacagagcgagactctgtctcaaaaaaaaaataataataaataaataaataaataaataattccattctttgtttttgttgttgttgtgttttattttgttttgttgagatggagtctcactctgtcgcccaggcttgagtgcaatggcacaatcttggcttaccgcaacctctgcctcctgggttcaagcagttctcttgcctcagcctcctgagtagctgggattataggcacgcaccaccactcccggctgatttttgtatttttagtagagatgggattttgccatgttggccaggctggtcttgaactcctcacctcaggtgatccgcctgcctcggcctcccaaagtgctaggactacaggcgtgagccactgcgcccggcccccattctttgtttataccacattttgtttatccattcatccattgatggacacttgggttgtttccaccttttggccatttgaataatgttgctgtgaccattggtttacaaatatttgtttgagtccctgttttcagttttttagggtgtatatctaagagtggaattgctggatcatatgatgaccatatgtttaccattttgaggaaccaccaaactgctttccatagcagctgcataattttacattcccaccaacaatgtatgtaggttccaatttctccatatccttgccaacatgtattttcctttcttaaaaatttcttttgatttttattaattaattaatttaaaaattattattatttttagatagggtcttattctgttacccaagctgcagtgcagtggcgtgatcatacttcactgcagcctggaaatcctgtgcttaagcagtcttcccacctcagcctcctgagtacctgggactacaggtacctgccacctccccaggccctattttttaactataatcattctgatgagtgcgagtggtatctcattgtggtttgatttgcattttctaatgactaatgatgttaagcatcttttcatgtacttcttggccatttctatatttttgtagaaatgtctattcaagtcctttacccatttttgtttgttttgtttttgagatggggtctcactctgtcacacacattggagtacagtggtgttatcttggcttactgcaacctccacctcccaggctcaagcgatcctcccatgtcagcctcctgagtagctgggaccataggtgtgcaccaccatgcccagctaattttttataattttggtagacattatgttttgtcatgttacccagactggtttggaacgcttgagctcaggagatccacccacctctgcctcccaaagtgctggcattacaggcatgagccaccgtgctcagccctttgcccatttttaaattaggtttttgtcgttttgaggtatgggagttatttatatattctggatattgatcccttatcagatatatgatttgcaaatattttctcccattctatgggttttcactcccttgatagtgtcctttgatgcactaaagtatttagtttcaataaagtcaaatttatctatttctttttctttttctttctttctttcttttttttttttgagatggagtctcactctgtcactaggctggagtgcagtggcacaatctcagctcactccaacctccgcctcccaggttcaagtgattctcctgcctcagcctcccgtgtagctgggactaggggcatgcaccacaacgcccagttaatttttgtatttttagtagagacggggtttcaccatgttggccaggatgatctcaatctcttaacctcatgatctgcctgtctcagcccctcaaagtgctgtgattacaggcatgagctactgctcccggcctccattaagttttaagatggcactcaccatctttgtgaaaagttgaacattactaacaaagtctaatcatatctttagaaggggtaaacagtgataccatttactgaattggaattactattaaaattaaaaaaaacagcatattcatttaaccacaaaccagtcttagttttaaatgaggaccacccaacaagatattctgtcagtcattcatgatctgaattctggtgtatgagatctattaaagtatggtacacataaaaaagtcatgagatatttgttttgtaataaataaggcagtgaccaattattactcattagtagcttttttgagttaagctatcaagtttgccctttctgccttcttaattccggcaaagatcatttttcttccagggatgtacttcttgggattctccaaatactccatcagtgtatcctctccccaggtgatgcctttgttcttattggtgtctgtgtaagagaatccagtggcctgacctgtcttccgcacgaagagaccgtggagattaggcccactcttgtgcttgtctcccttttccaccgtgtggcactgggcacacttctgaacaaaaatcttcttacctttctcagcatcacccatatataattctgtttttcatcgctggcaccacgaaggttgccactccaaagctgtacgacccactctctatcaattttttttcttgtgtttcttgtccttttggttgtcatgcttaagataccattgccgaatccaaggtcatgaaagttttcttttattttcttctaagagaaggttttagctcttaaatttaggtctttgatccactttgtgttaatttttgtatatagcttattttaatattttaaggatttaacgtcattcttttgcacatggatatccagtttttccagtgccaatttgttgagaagatggtcctttcaccattgaaattactttggcacccttgtcaaaaatcaatttgtcacatatatgaaggcttatctttgaactctgtattctatttcattggtctatacgtctgtccttctgccatcaccacactgttttgactgctgtagctttgtattaatattgaaatcaggaagtgtgggccctccaactttgttctttttcaaggttttggcagtttggggtcccttgaaattccatgtgaattttggtatggatctttctgtttctgcaaaacatgttgtgggactttgataaggattgcactgaatcactttgaatggtattagcaatattaagtgtcttccaatccatgaagacagtagctctttccatttccttatgtctttaatgtttttcagcaatgtttattttattattttattttattttgagacaatgtctggctctgtcacccaggctagagtacagtgatgtgatcctggctcactgtgttcttgacttcccaggctcaggtgatcctcccaccccagccttccgagtagccaggaccacaggcatgcaccaccacagctggctaatttttgtattttctatagagatgaggttttgccatgttacccaggctggtcttgaactcctgggttcaagcagtccagcagcctcagcctcccaaagtgttaggatgacaggtatgagctacttcgcccagccttgcctccatgtttaaatctttacctgagtattttattctagttcattattttggctgagcagtgatcaacattatgataattttcatatccttatagaaataataacaataaaagatattattattgaatgtctatcatgtgctaggcactgttctagaagttttttataatgtatcgctaatccttaaaacaaccttctccatttcgggccaggcacgtaatcacccctgtaatcccagcactttgggaggccaagacaggcggatcacgaggtcaggagatcgagaccatcctggctaacatggtgaaaccccgtctctactaaaaatacaaaaaattatccgggcgtggttggtggcgggcacctgtagtcccagctacttgggaggctgaggcaggagaatggcatgaagccgggaggtggagctagcagtgagccaagatggcgccactgcactctagcctgggtgacagagcgagactccttctcaaagaaaaaaaaaaaaagtccccatttcacagatgtaaaaattaaaacttggagagatgaattgacttgctaaagacacacagggctgggtatggtggttcacacctgtaatcccagcattttggaaggccaaggctggtggatcacctgaggtcaggagttcaccagcctagccaacatggtgaaaccccatctctactaaaaatacaaaataagccgggcatggtggcgggtgcctgtaatcccagttacccaggaggctgaggcaggagaatcgtttgaacctgggaggcagaggttgcagtgagccgagattgcccctttgcactctagcctaggcaacaagaacgaaagtccgtctcaaaaaaaaaaaaaaacagttagtaaacggtaaacgcctttatagtctagctatatggctcgatatccataccttcttttgctgtgccattccagcattttcatctttcttcatcatctcattgcaggatgacatgcacttggtgataagaaagcagctctctagcaccgtattcaagtacaagctcattgggattattggtgctgtgaccatggctggcatcatggcggcagacaggtacacgtggagattctgacttctgtggtttaagatcagttaatcttgctaactaagtgttacatctcatagacatcattttagcagtagaagttacaactataaatgagcaaatgtgttttgctacttttccatgttcccttctaatcgtgactgtatatattaccatgtatatgttttgctggaatgtgatcctagccattacagtctgtggttaaaaattaaggattggctagaggtaaaattctagaaatctttgcacaaaatgggaaccctgattcttttagaatgcatttttctttatctgctcctgatataggcactagacaatgcaggtgtctacattgctgtgtcattcctgtcgggaactttatacatttgatacaaataagatcttgtgtatttcccctcaccttgttccttgaggccccatttgtagaatctaaagaaatatcggtttgggggcttgataagatgttgccattacaaaccgacattggatttcagttcatgctccttggaatttattttctgagacatcaggagacatctttagaatccacattgtggaatcctaattagggaaaaggagtcacaatggtgggagcaaagaaagcaaagacaaagtatgtaagtctgccttttttcatggtgcaggacatgcagccctcctgcgcccaacttaatcaccagacacctgcaagttagctcactgcaactttggcattatcagtactgcacaaagccctcttcggcatacagcatacatcataaatactactctagaaatccccagcaagccgttgtttccttgcagtcagctcctctattgctggctgcccagtgctttcttgcaacgtacttttatactttctctaagaaatctgcctttctttacctacaactgtcttagtaaattctccctctaaccccaccccaaccgccaccggctcagatagtcatcactcccctgtgacacacattaataatgggaagaggttgcagagtgtgcaactctagttaagagttcagtcagtgaagccatactggttgcccagggtcagattctggctccattgtttattagctgaattaccttgggtaagttactttatctctctgcctttgtagactcacatcagcaataaggataataataggatttacctcatagagtcattgagaacattaaagggttagaacaatgtttagtacataatatgcactaattaagtgcttcctctaattattgctaatttgcccttaaaaaatatgtacgaaaaagaaaaaagaaaaaaatatataggataaccatcctttgctctaatctgtattttgtatggacaaaataaatactcttcgctgccttcatgcacttttatctttaccctaccctagggaagtcagaattcttaaacttattggcagttgttacaaaatattacaaaagtgaaattaaaattctgtgtttttaccaaacaccgcatgttctcactcataggtggtaattgaacaatgagaacacatggacacaggaaagggaacatcacacaccggggaatgttgtggggtgggggaggggggagggatagcattaggagatatacttaatgctaaatgacgagttaatgggtgcagcacaccaacatggcacatgtatacatatgtaacaaacctgcacgttgtgcacatgtaccctaaaacttaaagtataataataatttaaaaaaaaattctttgtttttagaagtgaatcacctagtttgacccaagagagagccaacctgagcgatgagcagtgcacacaggtgagttctttttttcctttctttctttttcctgtcttttttttttttttagagagtctcgctctgtcacccaacctgcagtgcagtggcaagatctcggctcactgcaacctccacctctcaggttcaagtgattctcctgcctcagcctccagagtagctgggattacaggcacgcaccaccacacccggctaattttttatgtttttggtagagacgaggtttcaccatgttggccccgctggtcctgaactcctgaactcaagtgatccacctgcctcggcctcccaaagtgctgggagtacaggcgtgagccacctcgcccggccgagttcttataatgtgattggatatgtttatgagtaactgaagaattgcttctagtcactgtcagttcaccagaaagtgcttcttttgtaaaagaagttttcctgaactcctacttctgtggttttctgacacttggaaactactggcttgggtagcatttatttttatgtttatttatttatttttagatggagtctcaactctgtcgccaaggctggagtgcggtggtgcttcccgggttcaagcaattctcctgcctcagcctcccaagtagctgggatcacaggcatgcaccaccatgcccagttaaatttgtatttttagtagagacggggtttcaccatgttggggtttcgctatgttgaccaggctggtctcaaactcctgatctcaggtgatctgcccccatcagcctcccaaagcactgggattacagatgtgagccaccactcccaggccagttgcatttatttctatatccatttaatctctctaattaaattataaagtcttagcaagaaagatatgccatgtttatggaataacactttggttgaagcatggggacaaataagtacataattggaaagtgggacataaagctagttcaggcagggcacggtggtttgcgattgtaatcctagcactttgggagaccaaggcaggaggatcacttgaggtcaggagtttgagaccagcctggccaacatggtgaaatcccatctctaataaaagtacaaaaaaattagctggacatggtggcaggcgcctgtagtcccagctactcaggaggctggggcaagagaattgcttgaatccgggaagtggaggttgcagtgagccgagatcacactactatactccagcctggacgacagagcaaggctccatctcaaaagaaaaaaagaaaaagctatttgagagagaaaacagagagccttgcatgtaaagcaatacatttttatttcattctttaggcagaggtattccttaagggtttcttagcatggaaatggcaaaatcaaaggtttactttagaaaaattaatctggctgcagtgtctggcagattggaaaagggatgatatcagaaggagacagacgggtcagaacattcaggaaaacttcaagtgagacatagagctttgccagtaaaatcagaaagtgaaaaaacagtcttgaaaggggcgagtggagtttgggaaagattggcagcccaaggtttaaaccattcttcctctttgctccaggtgacctccttgttgcagttggttcattcctgcagtgagcagtctcctcaggcctctgcactttactatgatgaatttgccaacctgatccaacatgaaaagctggatccaaaagccctggtaaagccaattgtcttttcttaaagcaataaagcatgagagctgctttactacactcttcaagtctttctgttgcagtgtgaaaatagatcatcctgtgacctctcctaaattctaactgggaaaggcttttctgccctaccctgtctcacggctcttctctgagggctccttcacttaataacaatcacgatagtaaagaagagattgactttgttaatgatgatggctattatctgtctgagagccctattctgtgctgggccttgtgctaagtgctttttatgcactctctcttttctacttcacaatagtgagatatttattattactttctttttagaaatgagggaactgagacttagaaaggttaagagtaatttatctagggctgtacagcaagtacactctgcactgccctttttgtttgtttgcttcctgaaggaatgggttgggcataccatctgtaatgatttccaggatgccttcgtagtggactcctgtgttgttccggaagggtaggtattgtttacctgctggcttggttgcactggtgaagttacatcaattctgtcagtagctgatacaaacttcagaatacccttcacctcagccacagctgcccagtcccacagcttctttcctcccaaccccagcacccctgcacccttagctccaaaattcctaaaaggttcactgtttgttcttctaatttctccccatgatgttgtgtttgaaattggtttgctctagtggttttccctgtagccttgcgtattcctgagctgcaacatcagattctggtttttctccgcagtgactttccatttcctgtgaaagcactgtacggactggaagaatacgacactcaggatgggattgccataaacctcctgccgctgctgttttctcaggactttgcaaaagatgggggtccggtgacctcacaggaatcaggccaaaagtcagtatagtttttcttttctaaacctgttagtgttttgaatgttcatggggaattccacagctcttggtggggaagttgagtcaaaaaagtttctctcgagacaaatggtatttggagaggttagggagaatggggcagattccttgttttttcttggatccttggcttgagatttatattgccttgtgtgagccaacagatattctgagattactttctggccaacgtggcgaaacactgtctctactaaaaatacaaaaattagccgggcagtgtggcatgcacctataatcccagctactcaggaggctgaggcaggataattgcttgaacctgggaggcagaggttgcagtgagctgagatcgtgccactgcactccagactgggcgacagagcaagactctgtctcaaaaaaagaagttgtgttccctatgtatgtggagtaatatctccctatgtacgtggagtaatacacctatgaagtgtggtctagaaatttatttctccttctcagattggtgtctccgctgtgcctggctccgtatttccggttactgagactttgtgtggagagacagcataacggaaacttggaggagattgatggtctactaggtatgggatgaagtcatcagatcctttcttctttatactcttcctttggtaaacttagggaaagggcagatcaatacatggtgtatgtggggaggaattttctaacttcagcagaatagtttatcattggaattccaaagacaaaatagtacatacagaatcccattatgttaacaaatcaattgttgcaaaaactttctagttatatttgttgattgctatatgatatgcaaatattttaatcagatcttggccttcaaatatgagttaaaggggaaagtaaatagcaaggacagctagctccagaggcaacctccaggttttattggcttgcactaaaggtagttggaaatgtttgttctctctcagattgtcctatattcctaactgacctggagcctggagagaagttggagtccatgtctgctaaagagcgttcattcatgtgttctctcatatttcttactctcaactggttccgagaggtgagcagagttaataggatgtttcacttattgtgcatagtttttctcaaaactattttcttagttcccacaagactccctagaagtcttcaccaagcactaacccccgtgtgcttctctagctgttatgtcccaccactccccagttatatgaacctccttaggtagccaaatgagaatacttagaattcacttcacattgcccatgctttattttctccaagctgccttctccctagaatgaccttctcaccttcactgtggaactactgttcgtcctggcacaggcatatgcctactgttttgattcagtgagtggtggtagtttccctcccattagaatgtatttgtgtttggtgataatgacaatgatggcaacatcttatatctctacctcactgtcttcctctctgatattatttcaggaatgtttgtgcacttgaatgagcttatttgattaccacatctctattatgatacgggcaggatagctattgtcctcattttacacatacgaatttcaatagggagttcaaagtcattaaaaatttttaagtacttacactgtaccaagtgctggactcatttctttatgaagaaatacttagaaaggttaaagactcagccaaggtcacacagtaagtagcagtatagaacttgtttcaccaaattgtgtgctgtctggctattccaccttgtaacataactagtaataagtaaaactagggtcacaagcctaatctcctttgttttttgtttttttgagacagagtcttgctctgtcacccaggctggagtgcggtggctcaatctcggctcactgcaacctccgcctcccaggttcaggcaattctccttcttcagcctccctagtagctgggattacagatgtgtgccaccatgcccagctaatttttgtatttttggtagacatgggctttcaccatgttggccagactggtctcaaactcctggcctcaagtgatcctcctgcctcagcctcccaaagtgctgggattacagacatgagccaccacgcctggctgaatctcctatattttgggccagagattttttttctgtataccacgttgttgaggacagttctattacagactaaactcaaagatcttgcttttcatagacatctctcagctctggataaataatataaacaaggttaaaatctgaacatttggaagtatgagaatgtaatttgtactttgcagattgtaaatgccttctgccaggaaacatcacctgagatgaaggggaaggtgctcactcggttaaagcacattgtagaattgcaaataatcctggaaaagtacttggcaggtaagagaagtgtcctatactggtagtactactaggccagtagtgaggcaataaagcacttagctttccctgataccaaaaccagacaaagacacatcaaaaaaagaaatctcaggccaatatccctgatgaacattgatacaaaaatcctaacaaaatactagcaaacctaattcagcaacacattaaaaatatcagctgggcacgaggtggctcacgcctgtaatcctagcacttttggaagccaaggcgggtggatcacttgaggtcaggaattcgagaccagcctggccaacatggtgaaaccctgtttgtactaaacatacaaaaattagccaggcgtggttgtgggcacctgtaatcccaactacttgggaggctgagacaggagaatcgcttgaacctgggaggcggaggttgcagtgagccaagattgtgccactgcactccagcctgggtgacagagcgagactcccatctcaaaaacaaacaaaagaaagattattcatcatggccaaatgggatgatttatcccagggatgcaaggattgttcaacatatgtaaatcaatgtgatacctcctatcaacagaatgaaggacaaaaaccacatgatatttaaattgatgcttaaaaaaattttataaaattcaacatcctttcatcataaaaaaccctcagaaaactgggtatagatccatagctactattaaactgaacagaaaaaaactgaaagcctttcctctaagatctgaacaagacaaggatacccacttatataataccactattataaaatacagtattggaagtcctagctagaacaattagacaagagagagaaagaaagaaagggcatccaaattggaaaggaagatgttaaattatccttgtttgcagatgatatgatcttatatttggaaaagcctaaagactccaccaaaaaactattagataaattcagtaaagttgcaagatacaaaatcatcatataaaaatgagtagcatttctgtatgccaacaactaagaatctgaaaaaaatcaagaaagtaatccatttacaatagctacaaataaaataaacaaaagttacaaataaaataggaataagcttaaccaaagaagtgaaagagcactataatgagtactatgaaacattgatgcaagaaattaaagagcaaataaaaaaaggaaagatacttcatgttcatggatcggaagaattaatattgttaaaatttccatgctacccaacacaatctacagattcaaggcaatccctattaaaataccaatgacattcttcacagaaatagaaaaaaaaaaagcctaaaatttatatagaaccaccgaagacccagaatagccaaagctgtcctgagtaaaatgaatgaaactggaggaatcgcattacctgacttcaaattatactacagagctatagtaaccaaaacagcatggtgctggcacaaaaacagatgcatataccaatggaacagaagagagcccagaaataagtccatacacctacaatgaactcattctcagcaaaggtgccaagaatatacattggggaaagacactctcttcaataaatggtgttgggaaaactggatatccatatgcagaagaatgaaactagacccctatctcttgccatatacaaaaatcaaaatggattatagacttaaatctaagacttcaaattatgaaactactaacaacaacaacaaaaaacattcagaaaactcttcaggacattagagtgggcaaagatttcctgaggaataccctacaagcacaggcaaccaaagcaaaaatggacaaatgggatcacattaagttaaaaagttaagttcctttcctctgcatagcaaaggaaacaccaaagtgaagagacagcccacagaatgcgagaaaatatttgcaaactatgtatctgacaagggactaataactggaatatataaagataggaaaaaaaattattcggattgaaaaatgggtaaaaggtctgaatagacatttctcaaaagaagacatacaaatagtggatatgtgaaaaggtgctcaacatcactgagcctcagagaaatgcaaatcaaaactgccatgtgatgtcatctcaccctagttaagatgcctctccccctccccctccccctccccctctcccgtctccctctgatgccgagccaaagctggactgtactgctgccatctcggctcactgcaacctccctgcctgattctcctgcctcagcctgccgagtgcctgcgattgcaggcgcgcgccgccacgcctgactggttttcgtacttttttggtggagacggggtttcgctgtgttggccgggccggtctccagctcctaaccgcgagtgatccgctagcctcagcctcccgaggtgccgggattgcagacggagtctggttcactcagtgctcaatggtgcccaggctggagtgcagtagcgtgatctcggctcgctacaacctccacctcccagccacctgccttggcctcccaaagtgccgagattgcagcctctgcccggccgccaccccgtctgggaagtgaggagcgtctctgcctggccgcccatcgtctgggatgtgaggagcctctctgccaggctgcccagtctggaaagtgaggagcgtctctgcccggccgccatcccatctaggaagtgaggagcgtctctgcccggccacccatcgtctgagatgtggggagcgcctctgccccaccgccccgtctgggatgtgaggagcgcctctgcccggccgcgaccccgtctgggaggtgaggagcgtctctgcccggctgccccgtatgagaagtgaggagaccctccgcccggcaaccgccccgtctgagaagtgaggagcccctctgcccggcagccgccccatctgagaagtgaggagtccctccgcccggcagccaccctgtctgggaagtgaggagcgtctccgcccggcagccaccccgtccgggagggaggtgggggtcaggccccgccaggccagccgccccgtccgggagggaggtcagggggtcagccccccgcccggccagctgccccgtccgggaggtgaggggcgcctctgcccagccgcccctactgggaagtgaggagctcctctgccgggccagcctcccggtccgggagggaggtggggggggtcagccccctgtccggccagccgccccgtccgggaggtgaggggcgcctctgcccggccgcccctactgggaagtgaggagcccctctgcccggccaccaccccgtctgggaggtgtacccaacagctcattgagaacaggccgggatgacaatggcggttttgtggaatagaaaggggggaaaggtggggaaaagattgagaaatcggatggttgccgtgtctgtgtagaaagaagtagacatgggagacttttcattttgttctgtactaagataaattcttctgccttgggatcctgttgatcggtgaccttacccccaaccctgtgctctctgaaacatgtgctgtgtccactcagggttaaatggattaagggcggtgcaagatgtgctttgttaaacagatgcttgaaggcagcatgcttgttaagaatcatcaccactccctaatctcaagtacccagggacacaaacactgcggaaggccgcagggtcctctgcctaggaaaaccagagacctttgttcacttgtttatctgccgaccttccctccactattgtcctatgaccctgccaaatccccctctgcgagaaacacccaagaatgatcgataaaaaaaaaaaaagaaaaaaagaaaaaaaaaaaaagatggcttttatccaaaggacaggcaataacagatgctggtgagaatatggagaaaagagaacctttgtacactgttggtgggaatgtcaattagtacaagcactatggagaacagtttggagtttcctcaaaaaactaaaaatagaatcaccatatgatccaggaatgccactggtaggtatatacccaaaagaaaggaaatcagtataccaaggagatatctgcactcccatgtttattgcagcactattcacaatagtcaagatttggaagcaacctaagtgtccatcagcgggtgaatggataaaatgtggtccgtatacacaatggagtactattcagccataaaaaacaatgagatcctgttgtttgcaacaatacagatggaactggaggacattatgttaagtgaaataggccaggcacaacatattttcacatatttgtgggagctgaaaattaaaataatttaactcatggagatagagtagaagtatggttaccagaggctggggagggtaatggtggttgggggactgggaaaaatgagggtggttaatagcttcaaaaatataattagatagaatgaataagatctagttgtttttgtatttttgagatggagtctcgctctgtcacccaggctggagtgcagtggcacagtctcggcttactgcgacctctgcctcctgggttcaagcaattctcctgcctcagcctcctgagtagccgggactagaagtgtgcaccaccacacccagctaatttttgtacttttggtgcagatggggtttcaccgtgttggccgggcttgtctcgaactcctgacctcaagtgatccaccttcctcggcctcccaaagtgctgggattacaggcatgagccagagagcccagccaagatctagtttttgatagcacaacagggtgactacagtcaacaataacttactgtacatttaaaaataactaaaatagtataattggattgtttgtaacacaaagaaatgataaatgcttgaggtgatggataccccatttaccctcatgtgattattatacattgtgtacctgtatcaaaatatctcatgtgcgccataaatatatatatacctttcccttttttttttttttttgagacagaggcttgctttgtcgcccaggctggagtgtggtggtgcgatctctgcttactacaacctctgcctcctgggttcaagcaattctcctgccacagcctcccaagtagctgggattacaggcgtctgccagcacacctggctcatttttgtatttttggtagagatagggtttcaccatgttggccaggctggtctcaaactcctgacctcaggtgatccgcgcgccttgacctcccaaagtgcttggggttacaggcgcgagccaccctgcctggccaccatttagattttaaatgtttgttttagtttttttctgtttgttagttatatatcattatttaaagtggttttatgataattgatcatacttaatatgatatttctgtgttatctctggccattttgctatgccaaaacaatgtcagatgacttgaatatgtcttataagcattcagccatgcttggtaattttggaaactagtttttagccaatggagtgactgaatttcaagtctaatggtggtgtgtaattggtacacattgagcttcagcctgctgtttgtttcagtcaccccagactatgtccctcctcttggaaactttgatgtggaaactttagatataacacctcatactgttactgctatttcagcaaaaatcagaaagaaaggaaaaataggtaagtatgttcttttcctcttgtcttgtgtctctaaataagcttcattgaattaacctaaaagttatgtgtatcatggcatcagtaattggaacaattgtataactgaactcttcctttattagatttataaatatactgtaatttagggttataaaattacctcttctacctctaggcagtttccaacaggttgttttctgagggcaatgatatttggcaaacatgattattaattacttgagtcacttttctctttttaatataaaagaaaggaaacaaaaaacagatggcagcaagacatcctcctctgacacactttcagaagagaaaaattcagaatgtgaccctacgccatctcatagaggccagctaaacaaggtattggaatgatgggtatccgtgaaggtttgtgacatcccagtgagattaacagaaacccagctttattctcggcattttacaaagaaaaaaaaattaggaaacagcgagccaaaactctcttaggcgttggagtaatctccttagtagcaaagttcagattagacttcaggtccttattcctgccacacactgttgactgttttttctaattattttcttgactgttttactcccttttttgtaccccagcagtacattgaattctctcttgaggtacttgattatcagtagttcccttttactttacatttgtactgttcgtagaatgagtttcatgtgtttgaaattgcctgggccacatggatcccaattatttctgttgatcagccaccatttattgtatatttattaggtatagtttctgtaagagcccaagtttcatattaataccacatttaataaaggaggaaactaagatccagggagggcaagtgacttgcccaaagtcacacagttaataaatgctggagctggggtttgaagccagatcattctggcccctaagctcacagttttttgttttttgttttttgtttttgagatggagtctcactctgtcacccaggctggagtgcagtggcacgatcttggctcactgcaacctccacctcccgggttcaagcgattctcctgcctcagcctcccaagtagctgggattacaggtatgcaccaccatagccagctaatttttgtatttttagtagagacggggtttcaccatcttggccaggcaggtctcaaactcctgacctcgtgatccacccacgtcagcctcccaaagtcctgggattacaggcatgaaccaccacacctggccagctcacagttttctgtactagacctaaatgccttgatttgcctaatagatcatccctaaatagatgacctgttaagggtcttgatgtgtgacttgtatccccatcttaaattaggtgctctgtcttgggaatatttagggacttgggctagaggaagttgttattataatgaaaatgtaattttttgcattaaataaatgcatatttgtactttgaagtttttattaaaattcgattaatatagaagatttatatattctctttgttgctgtgacttccccataggagttcacagggaaggaagaaaagacatcattgttactacataattcccatgcttttttccgagagctggacattgaggtcttctctattctacattgtggacttgtgacgaagttcatcttagatactgaaatgcacactgaagtaagtgacaggctaggatctcagaatttaatcttctttcagaaagttcctcaggtctattcttatttcacaaagaacactgtgacactgaggagagaagttagactgacttttaaagcctttatatgtgaaagcaatgatgaataatcatcctcatactggtgtttgtaagtcataaggtttgtaataatgtgtcagacattataaaatatcatgccaatgatgtaatccttacatttaggttactactactactactactaataagctacctagattatttttgtagaggagcactcttctggttcttagaagtcaatgcccttttcactttttcacaacatttgttcagcacctgacagttgcttactgagtcctattttgtgtttgccactaatcaaagcacttgcatttcagtagtacatagagcatcatgcttgctttcaaataacttctaatctaatcaaagaagtggaaatagctagcaatacggtagctttattattattattttcttttttttttttgagatggagtctctctctgtcgcccaggctggagtgcagtggcgcggatctccactcactgcaagctctgcctcccgggttcacgccattctgctgcctcagcctcctgagtagctggggctataggcatccgccatcacacccggctaattttttgtacattttttatagagacagggtttcaccatgttagccaggatggtctcgatctcctgacctcgtgatcacccgccttggcctcccaaagtgctgggattacaggcgcaagcccccgtgcccggccccatagctttattgatgccaaatacggcattaatggtctgaaccaaggactagtgaaactctagtgagagaatgatgtttatatagaagttgggagtagaggacattttcacagataaagtaacttttgagatgggatttcatcagagagtagaatttctctaggtttaagagaaattgaaatagcattaattttcacctgaaatttacacgaatgtaggtaccttcagaacagaaatagtatccttttttttttttttttttttgagatggagtctcgctgcgttgcacaggctggagtgcggtggtgggatcttggctcactgcaagctccgcctcccgggttcacaccattatcctgcctcagcctcccaagtagctgggactacaggtgcctgccaccatgcctggctaattttttgtatttttaatagagacgaggtttcaccgttgttagccaggatggtctcgatctcctgacctcgtgatccgcccgccttggcctcccaaagtgttgggattacaggtgtgagccactgcgcccagccatatcttttttttttttttttaatctttctacatcatcttgcccttaggagatgccacataaatgtgtattgagtgagcagtttgcagtgagactgtatttcacccattctgcttctagcagtgtaatatagctattccactgggatcactctggggtcctgcccagagttaatagtagcaaaacattagaggaaaacaagtatgaaaggattatttaatgaacagacaaaagggaaattcccttgaattagtcttttttttttttcccaaaccctgtgtgtggcattcaaagtcattttttaaatcacaggatatttaggaaacgcatcttggatccacaactagaaaggtatacagaggaatttatagagaaaaagtatgtcttctaaactatcctgtcttgaattattattttactattctgaatatttattttggacatgcttgactttattatatgacagagcataatagctatcctttatatgagatgggtgcagtttcctcccttgcctcttttttctttttagagacagagtcttgctctgtcacccaggctgaagtgcagtggcaagatcatagctcactgcaaccttgaactcctgggttcaaggatcaagtgatcctcccacctcagccttccaagtatctagggccactggcatgccccactacacccggctagtttttttatttgtttgtttgtttgttggagacggagtcttgctctgtccgtcagtctggagtgcagtggcacgatcttggcttactgcagcctctgcctcctgagctcaagtgattcttctgcctcctgagctcaagcgattcttctgcctcagcctcccaagcagctgggattacaggtgcccaccaccacatcagctaatttttgtatttttagtagagatgggatttcaccacattggccaggctggtctcagactcctgacctcaaatgatctgcctgccttgacctcccaaagtactgggagtttgagaccagcctgggtaacacagtgagacctgtctctacaaaaagttaaaaaaaaaaagtagccaggcatggtgacgcacacctgtgatcccagctacctgggcggctgaggtgggaccatcacttgagtccaggaggttgaggctgcagtgagctgtgaacacaatattgcactccagcctgagcaacagagcgagaccctgtctcaaatataagtaaataaataaataaaagtcaaattatttaccctgctgggcgcagtggctcacgcctctaatcacagcactttgggaggctgagacaggcgttatcacctgaggtcgggtttgagactagcctggccaacgtgatgaaacccatttctactaaaaatacaaaaattagtcaggcatggtggtgggcacctgtaatgccagctacttgggaggctgaggcaggagaattgcttgaacctgggacgcagaggttgtagtgagccaagatcatgccactgccctccagcctgggtgacggaacaagactctgtctcaaaaaaaaaatttttttttcacccattgggaagtattaacatgaaatagccaggtgtggtggctcatgcctgtccataatcccaataccttgggaggccaaggcaggaggattgctcaagcccaggagtttgaaaccagcctgggcaacaaagtgagaccccgtctgtataaaaaaatttaaaaattcgctgggcccaggtgtggtggttcatacctgtaatcctggcatattgggaggccaaggcagaaggatcatctgagcccaggagtttgagaccagcttgggcaatatagtgagacctcatttcttattaattaaaaaaaaaaatgtagctgggcatggttgtgtgtgcctatagtccccgctactcgggaggctgagatgggaggataacttgggcccaggagttcaaggctggaatagctatgatcttgccactgcacatttaacaaaaaagaaagaaaaaaaattatcatgaaatgactaggacattcctggaactaatcctttcctccatgtgacaggctacagaagttgtgcaacttgggccccctgagctgcttttcttgctggaagatctctcccagaagctggagagtatgctgacacctcctattgccaggagagtcccctttctcaaggttagtgtaggcagaagcataggacttgggcatagtggatttgggaacaaaggaggtattatgatgaaaaagttgtcactttctttggcattgtgtttgggtcactgggtagcatgggtgcagccgtattgccagacaatattcatcttgctttatttatttatttatttatttagagatggagtctcgctctgtcgcccaggctggagtgcagtggtgtgatctcggctcactgcaagctccgcctcccgggttcatgtcattctcctgcctcagcctcccgagtagctgggactacaggtgcctgccaccacgcctggctaattttttgtattttttgtagagacggggtttcaccgtgttagccaggatggtctcaatctcctgaccttgtgatccgcccaccttggcctcccaaagtgctgggattacgggcatgagccaccgcgcccggcctcatcttgctttaaataggaagtctgaaggctgggcgtggtggctcacgcctgtaatgccagcactttgggaggccaaggagggcagatcacttgagttcaggagttcaagaccagcctggccaacatggtgaaaccccatctctactaaaaatacaaaaagaactagccgggcatggtggtgcagctatagttccagctacttgggaggctgaggcatggggaggaggaggttgcagtgagctgagattgcaccagtgcactccagtctgggtgacagatttcgtctcaaacaaaaaaaaaagtctacctgtgcagtggttcacacctgtaattccagcacgttggaaggccgaggcaggtggatcacctgaggtcaggagtttgagaccagcctggccaacgtggcaagagcctgtctctactaaaaatacaaaaaaaattagccaggtatggtggcgcatgcttgtagtcccaggtacttgggaggctgaggcagaagacttgattgaacccaggaggcagacgctgcagtgaaccaagatcatgctactgcactccagcctgggcattagaacaagactctgtctcagaaataaaaaaaaaaaaataggaagtctgaaacagaaaatagaaaggcacttggaataagaaatgtatttctttttttgagacggagtctcgctgtgtctcccaggctggagtgcagtggtgcaatctcggctcactgcagcctctgcctcctgggttcaagcgattctcctgctgcagcctcctgagtagctggggactacaggcgcgcgccaccacacccagctaatttttgtatttttagtagagatggggttttaacatgttcatcaggctgatctcgaactcctgacctcatgatccgcccacctcggcctcccaatccgcccacctcggcctcccaaagtgctgggattataggcgtgagcactgcgcccagcctacgaaatgtatttctaaatgccctgaacattcctgaatcctgttctttacttgaattttggtttcaacagcctcccaaaccaagcctgggcccatgcctcagtgtagtagtaagctgtctagaacgtccagaacttcagatgtgtatacagtgtacaaacgtgcacctagcatccggggaagcagttggacggtacatataacaaaatgagaaaatcttgggtcttgggtataagcatttaaacattaatatatcccgtttcttggtttcttgattcatttttcttcttcgtcttcttttttttttttgaggcggagtcttgctttgttgccaggctggagtgcagtggcttgatcttggctcactgcaacttccgcctcctgggttcaagcgattctcctgcctcagcctcccgaggagctgggactacaggtgcacgccaccacacccagctaatttttgtatttttagtaaagatggggtttcaccatgttggccaggattgtcttgatctcttgacctcatgatccacccgccttggcctcccaaagtgctaggattacaggcaagagctacagtgcccagcaattcattcttctttgtattcactatcgggtctactttttgagacagggctttgctctgttgcccaggctggagtgtagtggcacaatcttggctcactgcaacctccacctccgggattcaagtaatcctcctatctcagcctcctgagtagctaggaccacaggcatgtgccaccgcactcagctaatttttgtattttttgtaaagaagagtttcagcatgttgcccaggcttctacatttttttgtttgtttgtttttcaattataatagggaggcagggcacagtggctcacgcctttaaccccaacactttgggagtccaagatgggtggattgcttgagctcaggagtttgagaccagcctggttaatgtggttaaaccccatctctataaaaaatacaaaaactagccatgtttgttggcatgtgcctgtggtctcagatactcaggaggctgaggtgagaggatcacttgagcccaggaattcaaggctgcagtgagctgtgatcgtgccactgcactccagcctgggtgacagagcagaaccttgcctcaaaaaaaaaattataagaaggagtctattgccctacatttgtcaacctaaatgatttctacttttatgtgacctttatctgattagttatgatagggctatatgtctcaatcaaacactgttcctactctacaaaagccaatctctcagtcattggaagatggagcaagatttttatccctctgtcagaatacagtcttaggttaacaactcatttctcccatctgctcctacctggtgacacaggtttgacttgactccattgcgaacccttagtttctgagacgctatccagcagtttcttcactcataactctgcatttattatagaacaaaggaagccggaatattggattctcacatctccaacagagatctgcccaagaaattgttcattgtgtttttcaactgctgaccccaatgtgtaaccacctggagaacattcacaactattttcaggtcagaagcctagacttagaagctgctaagcaaatatgaggtttcatttttggctgagaaaaaggaaaatgaggacaattactgaagcaactgtcctaaaatcatttttatttttagtgtttagctgctgagaatcacggtgtagttgatggaccaggagtgaaagttcaggagtaccacataatgtcttcctgctatcagaggctgctgcagatttttcatgggctttttgcttggtaagtatgtgggaagtgtggagagaactgagtatatacttgcttttatttgacagtcaccaaggcactgaaatgtagaaaagaaagaaaaggttcaaaaatcttatgtgaatatggttcattaattttgtgggagtgtttttgtctgtattatttcatttgatcttgtaccctctgagtcctttggagccactatgttaacccatttgacagattaggtgacttgctgatgagctgataacagatgtggccatctgttccttagtccagtttcctttagcatgctttaattccagattgtttggtgatgagctgaacactgtgagctgggctattccatgataccttcatggaaacagtgggactcaagggaaccccagaagggtacatggcctttagagagataacggaaggaagtggaaggtacaacatggacaaaagtagaactaagggaggtgtgccccttaaatacttttgttcctcagggacaggcgttgggctctctgttctcattatacaagatttctggtcaatcctacccaagcttaaatttagccaaaatttattttctgagctataggcatttatatccaactgcctacgcaacacctccttagatgtggcattgacacctcacactccacatccaaaatggaatatgtcatccctagcatgctccttcagctttgcctggcttagtaaatggtaccaccagttgcctgaaccagaaaccaggagttattctttgtccctccctctgctctccaccgtctttttcccacatctgattgccaaatcctgttgattttattttctgttataaataacatctagatagccatctgtccctgtttctccactgcttccagactcccattatctctcaacctggactgggctaggttcacacttggcctctctcagtccattcttcacatggcagtaagagtgatcttcctaacataaacccagtttgatcctatcccaattttgatttctgattgctcttagatttttcttgagttaaaactctcttacctagcctctaggtcttcttctgactcctgctattccacttattatgttatactctgcctccagcctcactgaattaatttgagcaccctatatagcttttacgtgggaggctttgcacatgttcattctcctgccaggacccccactcttcttgatccccagctttttctgactcatcacatctcttgagatctgaacttaagcatccatcctgcctctctaacccccagttctcttctaacactctggtatccgttcgtgataaaacttaatctcattttattataattacttgttcatcagtctttcctgctagactctgagctccatgaaggcagatgtctgtcatttttatatcctcattacttaaaagcagtgcctgacaaaaactttgaacaatttatcaaagagacttatagatggcaaataaacatgtgaaaggggcctgacatcgtggcttatgcctgtaatcccaacactttgggaggccaaggtgggtggatcacttgagctcaggagttcgagaccagcctgggaagcatggcaaaaccctgtctccataaaaaatacaaaaattatctgggcatggtggcatgcatctgtagtcccagctactcaggaggctgaggtgacaggatggcttgagcctgtgaggcagaggttgcagtgagccaagattgcaacactgcactccaacctgggcaacagaaccagaccccatctcaaaaaaaaaaaaatctgggccccatggcccagtgaagttaacacagaaaataaaccatctctaaaaattataaaaacaattaaaataaatacatgaaaggatgtttattacttcttaaggaaatgcaaattaaaagcacaatgagatagcacaacacactcactagcatagctacatcaaaaagacttagcatgccaagtgttggtgagaaggtggaacagctggagctctcacatgcttctagggggactttacaatggtacatccatattgggaaatagtttggtagtttcttaaaaagctagacatgcacctaccatgtgactcagccattccatccttaggtatttaatcaagggaaatgaaagcatacgtccaccgaccaggcgcagtggctcacgcctgtaatcccagcactttgggaggccgaggcgggcagatcatgaggtcaggagatcgagaccgtcctggctaacacggtgaaactccgtctgtactaaaaatacaaaaaattagccgagcgtggttgcaggcgcctgtagtcccagctactcaagaggctgaggcaggagaatggccttaacccgggaggtggagcttgcagtgagccgagatcccaccactgcactccagcctgggcgacagagcaagactccgtctcaaaaaaaaaaaaaaaaaaaaggtatgtccaccagggtctggtacaggaatattttgagcaatttagcctgtggttttacatagtatattctaaacttgtttcccatgcttttgtgtgtgtgtgagagacagagtctcactctgtcgctcaggctggagtgcagtggcgcgatctcggctcactataacctctgctgcccgggttcaagcgattcttctgcctcagcctcctgaatagctgagattacatgcgcctgccactgcacctggctaatttttgtatttttagtagagacggggtttcaccatcttggccaggctggtcttgaactcctgaccccgtgatctacccacctcagcctcccaaagtgctgggattacaggtgtgagccactacacctggcttttttttttttcttccctgagacagggtcttgctctgttgcccaggctggagtgtagtaacacaatcacagctcactgcaacctctgactcccaggctataaatcctcccacctcagcctcccaagcagttgggactgcaggcatgtaccaccatgcccagctgatttttccttttttttttctttggtagagacggggtttcgccatgttgcccccaggctggtcttgaacctctgggctcaagtgatccacccgcctcagcctcccaaagtgctggcattagaggcgtgagccaccatacctggcccaaattcaacattttaagtacatgaagtgtattgtacatcaactatatctcattgaagctatggtagaccaaaaacctgacacctaataggccctcagaatacatttgttgaaaggaagaatgactatcactggtgatcaggaagatgcttctagaggagaagatctaggacgtcagattgtgctgggcctcaaaggtcaggcagaataatttaaatgttgtccagggaagccattttggagttttatgatcacagccataatacaatgaaagcagtggtttaagaaaacacttctggcagcagagtgcaggacagattgaaaagggatgcaaaaaagaacactcaaaaggtgtcactatgatctacacatgtattgataggggcctggccaaaatgatggtctaggcttggaaaggaagggacaatatgaaaggtaatccaaagatagaaatgtcaagacttgactcattaatgtaggagaaggggtaagtaccactatgggctggacattgatttagcagtttgacaaaattattcctgtatttttgaagaagactacatatctctaaaatatagggaatgaaggagagctttttgcccttcaaagtaaacctatggcccaggcgtggtggctcacccctgtgaaaagaaagaggaaagaagaaaagaaacctatgaagacttcaggaaagattactttggatgtacttcagtttctactctgatacttagagctgtgattgaatttggtacttcagtactttccatttcaattcttttttcttttttctttcttttttttttttttttgagatggagtctcgctctgtcgccaggctggagtgcagtggcacaatctcggctcactgcagcctccacctcccgagttctagcgattcttctgcctcagcctctggagtagctgggactacaggtgcccgccaccacacccagctaatttttgtatttttagtagagacgggatttcaccgtgttggccaagatggtctccatgtgttgacctcgttattcgcccgcctcagcctcccgaagtgctgggattacaggtgtgagccaccacgcccgacctctcaattcttttttcaaaccgttaaactattgatggtacagactggaggccaggatccttaaatactatccaagtagttttccagaaactaagctaacccctcttaccttgacttccttaggagtggattttctcaacctgaaaatcagaatttactgtattcagccctccatgtccttagtagccgactgaaacagggagaacacagccagcctttggaggaactactcaggtgagtcataactacatagccaagattgttgtcccaagaaactcctaggaacaggattggcaactttctttaaaataacctgggtgtctttcagtagttgtaaaggaaattattttcagctactctcctcatatatgagctttctcatctatgtattctgataaatcctgaagtattagaaaccttgaataatcatgctaaatcttcatgaatgcatcagcccataaactcagccttttcaagtaataatgatgaaaacattgaccatctgtaatcaactcttgattatccagggacctactgtctcccagcagatttgggtaattaggcagcagctagttatcactgatagcctgtttctttccccttgtcttgtaggaagaccttatgtggctgaggggtaggcagtggacaagggaggtgacatgatctcaggggcatggctttcggccccctcccccttcagtcagagtgacttggtctttctctcacttcccttggtaacctagaccatcactgggtcagcagtcagtgcttatcatccctgtctataggtcaggaccttatatcttcttttttttttctttgagagagagtctcactttgtcacccaggctggagtgatcccagctcactgcaccctccacctcctgggctcaagtgattgtactgcctcagcctcccaagacgctgggattacaggcgcatgctgacacaccctactaatttttatatttttgtagagatgttttcgacatgtggccaggctggtctctaattcctgagctcaggtgatctgcctgtctcagcctagcaaagtgctaggattacaggcataagtcaccatgcccggcctgtgaacccagattttacaaattattttcagtgtattgcctaaggctttaaagagcagataatttatctagggttgtacatattagcgtggtgcttgggtttctcagcatacatgaccccttcaaggccaacattccatcagtggggctgtcttctgccctggctttttccatacaaaggtatggttttctaccaagatgcttgaagagggttgctactaaagcacctgaaaataaggaggattctgattaggccgtcaaacactgaaagggacttgggcacgtcatgtggatttaaatatatctgtgacacataggatactattgcatttgtttgtttttcttgtctccttacagccagagcgtccattacttgcagaatttccatcaaagcattcccagtttccagtgtgctctttatctcatcagacttttgatggttattttggagaaatcaacagcttctgctcagaacaaagaaaaaattggtgatgggcctagatcctttttttttttttttttttaatgaataggactaatatctcacacttacaaactttgggcttcccaggacatttttacatgtaaatccccacataaccttggataggccctcttgctataccaagaaggtcattttcccagaacaacctgactgatttctgctaaaattgcttagtctgagtttggttagacaagctgagtagatagttttctctttggcttaagtttaatcatgttcttccttttcaaaaaaaaaaaatttatctgagacatttgacaaaacgagacataaatcatgaggttaataaagtaggaaataaaggagaaatcagggtcaagtataaaagaaatactggcctcttccctggcctttttctttttttttgagacagagtctcgttctgtcacccaggctggagtgcagtggtgcgatgttggctcactgcaatcctctacctcccaggttcaaacgattctcctgcctcagcctttcaagtagctgggattacaggtgcgcaccaccgtgcccagccaatttttgtatttttagtggagacggggtttcaccatgttggtcaggctggtctcgaactcctgacctcgtgatccacctgcctcagcctcccaaagtgctgggattacagacgtgagccactgtgcccagccctggcctctttcttaaactgtcttttattgtagctcttagaatgcagctcatcctagttggcagcacatcagaaagcaagataaaaatgcaaaacaaacctttatttatccctattgattaaaaggggaaggtttggtctcaatcttggaggtgaccactgctattggccagcccaggaggaacaagattggccttcccactgcccagcagcattccttttctctgtgtgtctgtatttatgttcatgtttgcatgtttgtgtgtttcaagatggggttggggtgggacgtgttgagccttaggcaaatgagtttatgtctggcaaaagggccagtggatcaggaacgtgacagctttttgtaagttgcctgttagaccgggaacgtcttagtaaatctaaactaataatccttttgatcaataatcatcctcaaaaacctgaaaagcaagaatgaggtcaagttcccatatgtaagattcctttgtcttcttttctaacagcttcccttgccagacaattcctctgtcgggtgtggccaagtggggataaagagaagagcaacatctctaatgaccagctccatgctctgctctggtgagatgtttggtttcttccaatgagccaaatagcttttttctattttgctactgttgtttgtcagagactggacaaatgacctttttagtgggaatttgaaaacaatgaagtaggttaaaaatgaacacaatttggaacatgtggatcttaagatcctctggttctgttttatactgttagctaactgcttattgttaattcagatcatagaggaattagaggaatctgtagttgtattctactttgttaattagtgggtcaaatatttgactctcaatgcagtatctacctggagcacacagagagcattctgaaggccatagaggagattgctggtgttggtgtcccagaactgatcaactctcctaaagatgcatcttcctccacattccctacactgaccaggtaagggagttctttcctccagtttttcccttaagatagaatcatcatcaggctgggcacggtggcacacacctgtaatcccagcactttgggaggctgaggcaggaggatcaccttgaggtcaggagttttgagacccacttggccaacatagtgaaaccctgtccctactaaaaatacaaaaattagccgggcgtggtggcacatgcctgtaatcccagctacttaggaggctgaggtaggagaattgcttgaacctgggaggcggaggttgcagtgagccgggatcgcgccactgcactccagcctgggcagcaagagcgaaactccatctcaaaaaaaaaaagaatcataatcacactgtccaacgtatatagcttccacacaactgccttgctcctcctcatctaattctgatacagacagtagatataatcattcattcaataaagagagtctgttatgcattcctttcaagggctctcagctaatatatttgagaggaccatggtggtttttgttttgtattgttttgttttgtttttgagaaaacttgtcacccaggctggagtgcagtggcgtaatctcagctcactgcaacctccacctcctgggttcaaacgattctcctaccccagcctttcaagtaactgggattataggcacccaccaccacacccggctaatttttgtatttttagtagagattgggtttcaccatgttggccaggctagtcttgaacccaacctcaggtgatctgcctgcctcggcctctcaaagtgctgggattacaggcatgagccattgtgcccagctgagatattttagccatcttgagaacagggtgctcacatgtatgtctcacttaatgggtgtgtgtctcagaatatcaatagttatcttaacatttgtagtcttttcagtttataaagcactttcactttatctcatttgatccttttgataattctgtgaggttggtatcattgcccctattttactgctgaggaaaatgagagctagagaacttctcaagcttacacgtgcaataaaataaacatagaaccaggactcaaactcagatcttctcactgttacttcattgctttttccatactaccataacacctcctttcataaagttaattccattgtttgacaggcaatcttcttgggcttattactgagtcctttccgctcccccatcctcttactaaggaccctagtgaaaggacatttagagaggtagggaaggaagctacttttggttcctggttcttcccaggtagttctaagcagtgcatcatggtgtgggcacgcatgcttttcccgtcttctaggcatacttttgttgttttcttccgtgtgatgatggctgaactagagaagacggtgaaaaaaattgagcctggcacagcagcagactcgcagcaggtgagtaagataatagtcacttcaagaagtggactttggattacttggaagttgctgattttttttttttttttttttttttttttctgagacagagtcttgcttgttctgttgcccagactggagtgcagtggcatgatctcggctcactgcaacctcacctcctgggttcaagcaattctcctgcctcagactcctgaatagctgggattacaggcatgcgccaccacacccggctaatttttatattttttagtagagacagggtttcaccatgttggccaggctagtctcgaactcctgacttcatgatccacccacctcggcctcccaaagtgctgagattacagacgtgcgccactgcgcccggtggtagttgctgattcttctatgtcttgggtccaagttttctcctaagctgttttttgtttttgttttgttttgagtttctgagattcaggattttttttcaaagagttcctagtttaatttcctttccctctagttagaggtgaggaatgggctctcttttccttggctactgcccagtttgcctcctgctaactggcatgaggtaagccagcctgtttgagatactgtggatcttggcagcctgctaaccagaacggagctagacaagtaagagaaagggctagcatagggaagcagagaagctacagccagtatatgttttttcttttttttttctttttgagacagggtctgagtctgacatccaggttggagtgtagtggtgcaaacttggctcactgcagcctttgccttctgggctcagatgatcctcccacgtcagcctcccaaatagctgggaccacaggtgcacgccaccatgcccggctaatttttctatttttagtagaggcggggttttgtcgtgttgctcaggctggtcttgaactcataggctcaagcaatcctcccgcctcagcctcccaaagtgctgggattataggcataaaccactgcacctggcataaaccagtgcagcccagaaggcaaaggctgcagtgagccaagtttgcaccactgcactccaacctggatgtcagactcagaccctgtctcaaaaagaaaaaaaaaagaaaaaacatataccggctgtagcttctctgcttccctatgctagccctttctcttacttgtctagctccgttctggttagcaggctgccaagatccacagtatctcaaacaggctggcttacctcatgccagttagcaggaggcaaactgggcagtagccaaggaaaagagagcccattcctcacctctaactagagggaaaggaaattaaactaggaactctttgaaaaaaaatcctgaatctcagaaactcaaaacaaaacaaaaacaaaaaacagcttaggagaaaacttggacccaagacatagaagaatcagcaactaccaccgggtgcagtggcgcacgtctgtaatctcagcactttgggaggccgaggtgggtggatcatgaagtcaggagttcgagactagcctggccaacatggtcagtatatgttgcaaaggcttttacttacttgggaattgctgaagaggaaactttttagaaagtctgtccctatgaggtgttctaatgttaccacaacatgtgcaggcctcagaaccatcttgtggatgcactggttgctacatctaaggataattggcttaaatatctgtatagctatgtaattcaagaactatatcttagtgggaatacagtaagggaagtatttggctgtgactcagaggtgcccatatatttggctgccccagattcatgaagagaaactcctctactggaacatggctgttcgagacttcagtatcctcatcaacttgataaaggtgagtatggagactgcttgacacatctcaccaaataactgcagaaaccaagtgtcctggcttccaaaatggactttccttgctcctcttcccactcttccttggggcctgctctccctgagtcgtcttcttcctttgtccccctacccatcctggataaccccttttctcactaggcatttttttttttgtcttttccttccttcctcctacttatgccacaatactatttaatgactccttccatctgtaattccctcactttttcaccttgccttggatcctctatgatctgagcgcacattccctcttctaaccctgaatgccctcgttctcctttaaacacactgtgctctcacccactccatcgtggttttgctcagcttgttcccccagcctagaatgtccttgtctctccacctctttcatgtcttttttttttttttttttttttttttgaggcagggtctcactctgttgtccaggctggaatgcagtagggtgatcacagctcactgcagcctcaacctcctagactcaagaatcttcccactgaagcctctggagtagctgggactacaggaacatgccaccacacccagctaatttttctattttttgtggaaacagggtctcattctgttccccaggctggcctcgaactcctgggctcaagtgatccaccagcctcagcctcccaaaatgctgggatatcaggcatgagccagcatgcccagcctcatccagtctttcttaagtcttcagatcaaggttttggacctctaataatgccatcttctcaacactcccagttggaatcagtttatttctctttgctcgtctcttccttttcttgaacttcagttgtgataattactttattctgctttgtaatattaatttaaatgttgacattcctccattttagaattctctgcagcacccaaagctgtgctttgcgcagcgggaaagaggctggagtgctcaaaggagcagatctcagccttggtttcttgtctttcacctctccaggtatttgatagtcatcctgttctgcatgtatgtttgaaggtgagagatttactgggccctgtttcatatttattcttcctgtggatcactctagagaggacctcagctgagataaattgctcaatttcttgcccacaagccagagtttccagaatctatgccagtttagggaaggcaatggatgcattttcccaccctagttggatgattggagaagccagttttcctatgaatttgaaaacttttggtaagaatcttagtactaggaggaatggcttcagggcagttgagtttaggagcagtagttaccttccgtgccattccttaccaggcaaaagggaggaaggaggagtagatgatttttctttaaagtctatgggtggccttacaaatgtgggatctgatatcctgataattgccaaacttctcttttgtgggaatagcctgtattagccctagatttgatgggaagtccagtcagaatgttatggggagaatgctacttcgccactcctcaagtttccttccaagtggatggtgccccattcttgtcatctcctggtcactctccctttttactccacccttgcgcaatgtgggagatgggcaagttggagagaggagtcatttatctgattgggaaatttagaaattggtcatatgctttctcagctttacccagtttttccctcttgggagtaagttatcctcagatagagctcccctctactctatgctctcactcctaagctgagcaagttccctgtccatcgactgtatctgtggtaggtaagtctgcctaattctggggcttagttaacaggcctatttgatttttgtattaagttacattctccaaataaaccttttggacccttcccaatttgttttttatatatataaataagaaaataaaacccttgggctggatgagactattctgcctcaggggcctttcagtgagatacctcagctagaggtaacagtgtgtctctcttcttcagtatgggcgtctctttgtggaagcatttctgaagcaatgtatgccgctcctagacttcagttttagaaaacaccgggtaagagctaagagcagagaacaaagatatgcactgaagagttgctcagaagatatgtccttggtgactcctgggtggggctgggagtgttctacctgggctcctctggtccacttcagctgtagccagagatccccaaattggactgaatattccaaagtaggctgaactcctcaggcccactctggatcaaacccacctttctatttcttctccagatctgacagtggtcttccttttagcttgattttattgtgctactgcactctcaggtcctcatgtatcagtgtgtcatttgcttattcctttatgcttctgtaggtatactctcagaaatgattttaaaaaaaaaaaagctcatttgtgtcataaaaccctttgctgtggtaatgaacagtcttgacagttttttagccaatggcatccagggctagagtgatgaattaaggatagaatcacattatttcctatacatatttagcaagttgaacaaaatactcaccatatttggttggtccctcacagccctgaaagagaaagggaaggtggtattttatcctaatgttgcagatgggaaaactgagacatggtaacctatgtaaaactaaaatgcaggtcttataactctcagattgatacaagggacagaaatgggagagttgagaataagaggtagctgctattcctcctatttgagaggcaaattaagatgattatcagcataggctggaaactgcagagtttatcctctttggagcttttgattgcaagggtatcttgaatctaaaatgaaatcaggacatttcatagagcatttataaacttattggttataggaagatgttctgagcttactggaaaccttccagttggacacaaggctgcttcatcacctgtgtgggcattccaaggtaagaaggggagcaggttctatcagcagcctgcctgttggcttaatctgcagttgctattgggggatccatgggctaccatccttcttcctttatatctgggactgtgtctgtccaaaggcagtttattcagagcaaatccttagttgctccttgagattgggcagtcctctagaggggaatctccgcatctgaaatttgattcaaactccaaagctctttttcctctagaaacttcttgggtgacagaaatagaatgctggtatatgtttacttctgcaaagtcctctaggtaacaggactgtgatgtaagtgatgatcctgcaggagacaggaggtggctctaaagcagccatctgtagaggctttcatctgtgccacttactttcaaggaactcatctatgtcttatgagaacatcttagcattaaaggatttttccacttgaagccttcttatagttaatgaggtattgtcacgttttgtctgaatgaacacagaaccctagagttctgcagtcactggcaaaccaaatgattcttgagtccagtttctgttacttacttcctcctctggttctaaatttataaggtcctgaacagtgatttttttttttttttttttttgagacggagtctcgctttgtagcccaggccggagtgcagtggcacaatctctgctcactgcaagttccgcctcccggctggacagtgaatgtttaaggaattctcttagctaaacagggctactctattgtttaatatcagtaaaatatatattcaagaatattttaggtaaattcattgaagatcggccagtaagaggttatgaagaggaactagaggtgttggtggtatgtcttctaggctttgaattctttagctgccattctctttggattactctgccaaactattcctgtttgatggaacataccgttggcccatactggcagggcttgtgttcttattcaacattcaaaggtttctataagaaatgtgaaggcatgatgataaactcacaaaagatggatgttatttatttccattcagattcaccaggacacgagactcacccaacatgtgcctctgctcaaaaagaccctggaacttttagtttgcagagtcaaagctatgctcactctcaacaattgtagagaggctttctggctgggcaatctaaaaaaccgggacttgcaggtaagccttggatcctgctagtgataatcccctactcttattctttgtgacagcatcagatggcatgtaaggaaggtcacctaagccctcgtctctcagtaaggctacttttctcttaagtctgtgactgtttaactcttaaagttatggtacattactcatgggccctggtcacaggctgcacccctcatcttaggcagcaaggcaccaaaacatgccattgatataaacaatgcctcagacataaaggagtcagaccagtacaaacctctctccacagctagaggagctcctttaagccccactgagggtagattcataataacatttttgtatagggacaaacatttcttttgttattttttttcccctaagccaatctgtcttattccagaaattacaaattaatctcttattgggggacctgccccgataatcacgtaggttcttttctattttcctaagtgtcagctggcttgagaaataaagggacagagtacaaaagagagaaattttaaagctgggcgtccgggggagacatcacacgttgataggatccgtgatgccccacaagccacaaaaaacagcaagtttttattagggattttcaaaaggggagggagtgtgcgaataggtgtgggtgacagacatcaagtacttaacagggtaatagaatatcacaaggcaagtggaggcagggtgagatcacatgaccgcaggaccgaggcgaaattgaaattgctaatgaagttttgggcaccactgtcattgataacatcttatcaggagacagggttttgagatcaacaggtctgaccaaaatttattaggcgggaatttcctcttcctaataagcctgggagcgctataggagactggagtttatttcacctctgcagtctcgaccataagagacaggtacacccgggggggcccagttcagagacctacccctaggtgtgcattctctttctcagggacgttccatgctgagaaaaagaattcagtgatatttctcccatttgcttttgaaggaagagaaacatggttctgttccgcccggctcaccggcggtcagagtttaaggttatctctcctataccctgaacaattgctgttaccctgttgttttttcagggtgcccacatttcatattgctcaaacacacatgctgtacaatttgtgtagttaacgcaattattacagggtcctgagactatatacctccttctcggctgacaggattaagacattaaagtaaagacaggcataggaaatcacaagggtattgactggggaagtggtaagtgtccatgaaatctttacaatttatgtttagagattacagtaaagacaggcataagaaattacaaaagtattaatttggggaactaataaatgtccataaaatcttcacaatccacgttcttctgtcaaggcttcagccggtccctccgtttggggtccctgacttcccgcaacaatctctaattttaactaatgagcatttataaggttttttttagttgtctgattagctgaaatcttgtgttgtttataatactactttggagttacaacatttttcagatagggtagtataagcccttttctttcatgcttacaatatctgagtcttgtagtcaattatatatgaaatatataaaacagcaccacagagaattagcttcctttcttcacatcaaccttatgaggcagatactattgtttctgcataaaaattgaagctcagagaagttaagtaatttacctaatgtcattcaacagtgagtgggtggagccggagtttgagtccaaacagtcccaaatccagagctgatgttctgaaaccacctcaccatactgtcctttagcctccgcatggccattcgtgcttggtgtgatagtgcttagataccttaaggtatttgggaaattttagaaccatgttcagcatcgacttagagtcaccaatacagtctagccttttaaaatgtagtgtgatactagcatactaagatgaacctttcgttacattacttattgtatcagggccacagacatctcagaaacctggagttgagtatccctcctctagatgctgaatcacaagttggtatccatgtttgctgtgttttgaatggctaaaatatcttcctttgtattgcctgtaaactcaaccttctcccctattaccctaaatgtgatcattataacccaccattttcttggtccattcacatttagggtgaagagattaagtcccaaaattcccaggagagcacagcagatgagagtgaggatgacatgtcatcccaggcctccaagagcaaagccactgaggtatctctacaaaacccaccagagtctggcactgatggttgcattttgttaattgttctaagttggtggagcagaactttgcctacttatgtttattgtcaaatgcttctatgcccatttccattccctccataacagcttctgtgcttatataatttttgggacccagaagaaacaacgacacaatcttagaatcactcctgagtatctcgagttgtggcatttgttatagagttgacaattttctgcattatagcctctcattttccatgaattcatatctgaaaccattttagaagggagaagtcatcgaagtattttctgagtgttgagaagaatgagttaaaccatttaaacacatttgaaacatacaaaaatagaaatgtgaaagcatttggtgaaagccaaagcacagagtcagaagctgccaccttagagaactgaaataaaaatagaagttcttacgcttttttgtggtacagatgctttcgacaatttaaagaaagctaaataaaaatgtagacatggctggcgcagtggctcatgcttgtaatcctagcactttttgaggccaaggtaggaggattgcttgagtccgggagctcaaggcaaagctgcacaacataacaagaccctatctccacaaaaaaaatgaaaaataaacctgggtgcggtggctcacacctgtaatcccagcactttgggaggccgatgtgggcagatcacaaggtcaggagttcaagaccagcctggccaacatagtgaaaccccatctctactgaaaatacaaaaattagctgggtgtggtggcacgtgcctgttatctcagctacttgggaggctgaggcaggagaatcacttgaacctgggaggtggaggttgtggtgagccgagatcatgctactgcactccagcctgggcaacagagtgagactccgtctcaacaacaacaaaaaagtgtacatttataaaattttgtcacaattcaggtaggttatagacaccaaaaagctcagatttaagaacccctgctgtggggcctctgtctgtaatgcaatttgagtctgatccagaaagatcatttagtatgaaaagtctggcctgatggggtggctcacacctgtaatcgtagcactttgtgaggctgaggtgggaggaccgcttaagcccagaatttcaagaccaacccgagaccccatctctacagaaaaaatttttttgagctagccaggcatggtgacgcatgcctgtggtccctgctacacaggaggctgaggtgggagggttgctcaagcccaggaggtggaggctgcagtgagccatcatcacactccagcctggatgacagagcgagaccctgtctcaaaataaaaaagttattttatttacatggtccccagttttatttgtataatataccccttctacttttttctcagaatttgaggcagacaatatcctattagtttggtactttcccctaagcagatctctcatactagtatcgtaagccagacagaacagaattttgtactggattcctgttgagatacaccagcacagcacttctttttttgagacggagtctccctctgtcgcccaggctagcatgcagtggtgcagtctcagctcactgcagtctgtctcccgagttcaagcaattctcctgcctcagccttccaagtagctaggattacaggtgcctgcaaccatgcccggctagtttttgtatatttagtagagacagggtttcaccatgttggccgggctggtctcgaactcctaacctcagatgatctacccacctcagccttccaaagtgttgggattactttggcgtgagccaccgtgcactgccataccaccacttgtaataaatatttcattctatatcgaatgccctctttgttcctatgtcatatacatgcagtagagctggaggaccatagcttatttaaaattatgcaaattgggccgggcgcaatggctcacgcctgtaatcctagcactttgggaggctgaggcaggcagatcacctgaggccaggagtttgagaccagccttgccaatgtggagaaaccccgtctctaccaaaatacaaaaattagccgggcgtggtggcacatgcctgtaatcccagctacttgggaggctgaggcaggggaatcgcttgaacccgggaggcagaggttgcagtgagctgagatcatgccactgcattccagcctggtgacagagcaagactcctttaaaaaaaaaaaaaagttttaacagtgataatagtacagttgtgtatcctctaggagctgtattccagaggtcacccagagcagtaacctaaaatgcttatttatttattctttgccccttaggatggtgaagaagacgaagtaagtgctggagaaaaggagcaagatagtgatgagagttatgatgactctgattagaccccagataaattgttgcctgcttctgtgtctctgccagcctgtgatcattttgtgttagagtttgaaatccgctgtttgcctttcttactggtaggatccttttttgttcctctttttttttttttttttttttttttaaagacggggactcgctgtgtttcccaggctggagtgcagtgctgcaatcttggctcactgcaacctccatctcctaggttcaagcgattctcctgcctcagcctcctgagtagctgggacgacaggcacatgccaccatgcccagctaatttttgtatttttagtagatacggggttttaccatgtcggccagatggtctcaatctcctgaactcatgatccacctgcctcagcctcccaaagtgctgggattacaggcatgagccaccgctcccagccatattttgttcttaaagtggggtctttattaacttgtggacatcatggattgtctaacaccatcacagtccctggctcaggattctaatgtagcattatttattggtttggataaacccagctgtgctacactgcagagtaaaatctctgagtcatgattctggactttgggagctagttttgaaactctgatttattgtagaacttaggcttgtaccaattttacaaataaattctgttctaagttc

SEQ ID NO: 36 - DNA, 22 bp, Artificial
  synthetic primer
gatcagaaaccagaagaattgc

SEQ ID NO: 37 - DNA, 22 bp, Artificial
  synthetic primer
gaactaagaccataactcggtc

SEQ ID NO: 38 - DNA, 20 bp, Artificial
  synthetic primer
aggttgttacgaggcattgg

SEQ ID NO: 39 - DNA, 23 bp, Artificial
  synthetic primer
ctttgtccgaagtggatttttgc
